United States Patent 9,719,064 (GENOMICS OF ACTINOPLANES UTAHENSIS) - sequence listing, part 8

SEQ ID NO: 16053 - DNA, 9087635 bp, Actinoplanes utahensis (residues 3,635,055-5,452,581 of 9,087,635)
ggcgaccagggcggccaggttccattttcgggaatctcgggcgaggcggaccaggaaggagcggccggagcgccagccttccatgaagtgggcctcgtccaggccgaccattttgcgggtggacatcgaaccgccgtagcagcggcggacggccaggcggtgggcggtgtgcagcatcggcagggccagggactcctcggccgaccagtattctcgttcgattttcaggtcggggaggcgcaggccggccatggtgatgacggtgagggcggcgtcggcgccgagcaggtgctgcggggggcggccgaagaagagcagggcgagcggcatctcggcggtgtccaggagcaggttggccagctcgcggccctcgtcgtcgcccaaaccctgcagggtggtgaccacgtcgtcgagggtggaggtttcctcggcggggacctgacggaccgcgtgtcgcagcagggtggcggtggaggcctccttggcgacctgcggggggaccagcatcgagcagatgtcctggaccagcatgcggcgctcggcgcgggcgttggagacggcgatctcgaactcgcggtcgccggtggcgccggtggggaactcggagcggatcggggtggggatcaacgcgtacggcgcgagggtgccctgttccgagccggtcaagttcaaaactcggctgtacgggcggagttccggcatctggcacagccgggcgagcggaccggacgggtcgagcagggtcacctgtacgccgcggcgggcgttcaggtagccgagggcgcccatcagggtggacttgccaccgccgggctcggcgacgaacacgccgaggccggagcgttcccggacctccatcgggaagtgcaggtccaggaagaccgggcgacggcaggtgccggcggtgcggccgatcaggtcgccgcggcggtcgccgaccgtggaggcggcctgcgggagggcggcggccagcagtttgaccggcatccgccggacgtagccggtgttggcgatcggctcacccggaatgaattcgcgggccaactggtcctggttcttcggatgctgcagggagatccgcaactcgcgggagtacagctggatgaggcgacgggcgcgttccaggcattcctcgcggttggcgccgctgaccgcgatccggtgccagccgtgcgcccgggccgaatcggtgggcagacccgtggtcatctcgtcgccgatcaccagggcgcgcttggcgaggcgttccaactcgggcggggcgtcgatgccgtgctcggcatagtcgagctgctgcgagcggatcatccggagccggtgctccaggttcctgaacgagctgttcgagccgaggatgtcgatccgggaggagagctccatcggccatggcaggcgctcgtggaagtgcatccacggctcgtgccgctccgggatctccagcggctccatccggccgacggagaggaccgcgacgtggcgttcctcgccggtcatccggttgaccagcttgaccgtcgacccgtacggcgtgcggtagcgctcgacctgctcggtcagcgccagcagatcgccggtctcccagtggccgttggaaaccggggagagcaggccgggcggggccatgccgagcgccaccgagcggaacagcagccactccagctcctgcggagtgacccgccggccacgcatgccgaaggcgttgagcacctcgtcgaactgctcgaccgtacgcccgagtttgcgtcgttcgttttcggacgtgccgcggccgaaagcgcgcaggatccgctccgagaacgtgtcgccgagcgagcgccgggcgaaggtcacgcccaggtaggtctggccctccgcgtggttcaccgagagcagatggcgctgcgccgcgaccaggtggtcggaccaggatgtcgcgcccggcacgtcgggcagcggccgggtggtgaaggagtcgaccgtgcgggcccactcgtcggccgggaacgggcgggtggtgcgccgcaggtgcaggcggaagccggcgagcccggcgtactgctcggagatcgcgctcagcagcgcctcgcgctccgcgtcgggccggaacgcccagcggacctcgggcaggtgataccaggcggtgacggtgctctgggtgaacgtcagatggccggcgatctcgctgatcgccagctcgatcgccggatcgcggtcgttgaacttgagtttctgggggcgcagcgcggccggtttcgcggccttcggctccttggtgcgccggcgggccggagctttgtcggtgaccgtcgcgggcaccggcagcggtgcggcgaccggctagctagctagggcgggagcggccagctccggggccggggcgggcaggcggcgcggcgcgggccggctgtcttcggggccgtgcggtgcgggccggctctgttcggggccgcgcggaggccactcgtcgtactccgaccagtcgtcctcgtcctcgacgacgaagggggtggacgtgatcgccggtgatggtggcggggcggccgcgggcagcgcggtgacggtgccgtgggggaagccgttgcgggccggaccggatccgttggcacggtgaccgttggtcccggccggtttcgccggaggatcacccggacgggtgggcgccggcccggccgtgccaccgaacagatcgaggaacggtgagtcgatgtccatcgtcgtgtcgaccggcgtgctcagcggacgcaccgcgttcggcgcctggaacaccccgacgccgccgtgccccggtgcggcgaccagctcgtcgggctgctcgaccgcctcgggcgaggagtagtcgttcgggcgcacaccgttactctgcctgtcggcggtggaggcgcccgcgcggggatgcccgggcggaaggttcgtggtcatgcctgaacaccgccggcggggatggccacactggtcataccaactcctcccgaacccggatgcgagtggcgacaagtctcggatcgcgccgctcgacggctgactcgcgggtgcggcgccagtcggtgagcgcggtgcggatgacgacccgggccggccggtccgggtcgacatgccggaacacgtacgacgtcgacaccatggccagcgcgatctcccacgccgggaacggatcgaaggtgaacgtgatcagatagtggatgaccatgaagaggggcaccagcacgacgaacatgccgtactgcgcgtacggcaggtggacgggcagcgtgtaaccgggcgggcccagatagacgaggcgggcccggtagatgtcgtcgtcggtccggagccgcatctcagttgaagatcaacttaatcagcgcgtcaccgacgaagaacagggtcgccgccccggcgatgaacgccaggcccacgatcgcgatcgcggaactggtgagcaccttggagacctcaccgcggctcgcgcgaccgatgaagatcacgccgagcacggcgagcaggatcggcgcgatgttcttcgcgaagaaagtgacgatgcccgacgtgttgatgccggtgggctcggccggtgcggcgagcacactgctctggagcgccgtcatcacgtgaccggcgacctcggtggcaatcatcggtaaacctccccgtgtccggtatggggggtacggacacgctgcagtggtaaagccgttcggcaacgcccatatcgtgctacctgtagctcaccacgtcgagtgagccgttcgggcactgccatgcttgtctgctctcttcggtcacttcatgatgcccagttccgaagagtacggcgcgtacttgcgagcaacaagcgtccgtttcgttactcaaggtgaaggaatgcatgaatgtgcgtcaccaggtcatcgtacacctgttcgaacaaccctcgccccgtacgctcggcgggtgctgactccgccgacagaagcccagctcatcggggctgatctgatgcatcgcgatcacccggtcgtgatgggcgtcctgaacgtcacgccggactccttctccgacggcgggcgctacaccgacctggacgccgccgtcgaacatggcatttctttgtacgcgcagggggcggacatcatcgatgtgggcggtgagtccacccgcccgggcgccgagcgggtcgacgccgcgaccgaggccgcccgggtggtcccggtgatcgccgcgctgaccgctgccggggtgccgctgagcatcgacaccacccgcgccgccgtcgccgaggcggcgctggcggccggtgccgcggtgatcaacgacgtctccggcgggctggccgacccgggcatggccgcggtcgccgcggcggccggctgcccgtggatcctgatgcactggcgcgggcactcccgcgacatgcaacgcctggccacctatcaggacgtggtcaccgaggtgcgcgacgagctgcgggcccgcgccgacgcggcggtcacggccggggtggacccggcgcggatcgtcctcgacccggggctgggcttcgccaagaacgccgagcacaactgggcgctcagcgcgcggctcgacgtactggtcgccctgggcttcccggtgctcttcgcggccagccgcaagacctacctgggccggttgctggccggcccggacgggacgccgcggccggtggacgggcgggaggcggccaccctggccacctcgctgctggcggtcgcggccggcgcctggggcgtccgggtgcacgaggtccgggagaccgccgacgcgctcgccgtctggcgcgccaccggagcgcctcggctggccctggagaagtaggggaacgatggggcagatcacactcaccggactgcgcgcccacggccggcacggggtctacgacttcgaacgggagcagggccaggacttcgtcgtcgacgtccggctcgacctggacctgagccgggccgcggcgaccgacgacgtcgccgacacggtgcactacggcgaactggccaccgctctggtcgcggtgctcaccggtgagccggtgaacctcctggagcgcctcgccgaccggctgctcgacgtctgcctggccgatccgcgggtgtccgccgccgaggtgacggtgcacaagccgcaggccccgattccgcacgagttcgccgacgtggcggtcaccctgcgcagagaaagcagagaaagcagagaagacggagaaagaggcaggggaagcgaacgggggagaggatgagccgcgcggtgctgtcgctgggcgccaacctcggcgaccgcctggcccacctgcgggccgctgtcgcactgctgggcccggccgtgcgggcggtctccccggtctacgagacgccgccctggggagacgcggagcaacccgcgtacctcaatgccgtcctgatcgtcgaagacccggcagcgacgccgcacgactggctggagcgggcccgggcctgcgaggcggccgaaggtcgcgagcgcgacccggaccgccggttcgggccgcgcaccctggacgtcgacgtgatcgcggtctgggacgccgacgggcgcccggtgcaccgcgacgatccggagctgatcctcccgcacccgcgcgcccacctgcgcgccttcgtgctgaccccgtggcgggacgtgcagcccgacggtgagctgcccgggcacggcccgctgaccgggctgctggccacgcccgaactcgccgccgacgtcgccggagtcacgcctcgtccggatctgtcgctagagtcgtaggcgtgagcgccaatcccgacggctccccgaccgggcgccggaccgacccgtcactgcaaccgacgagcgtctcggctctggtgctggccgccctcgtcggcgcggcgctgggctggctcctgctcggctacaacgagctgttctaccggctcaccccgctgccctggacgggggcgatcgtgctgctcgccctcgccgtggtcgagggctacctggcgcagaacaccagcgcccggatccagcgcaagcccggcgcgccgcgggtcgacccgctggcggtggcccgctatgtcgcgctcgccaaggcctcctcactggtcggctcgctgaccgcgggcttctccgccgggatcctgatctggctggtcacccagccgaccgattcggccaagtcggacctgccgacggtggccaccacgctgatcgccggggtcgcgctgatcggcgccgctctctggctggagcgctcctgccgggtgccggacgggccggatcgcgacgacgacgatcccgaccggcggcgctgaaccggcggcggcgatcccggccggcggcgctgaaccggcggcggcgatcccggccggcggcgctgaaccggcgacggcgatcccggccggcggcgctgaaccggcgacggcgaacgcgaccggcggcgctgaactgaggccatctcgtatccgtatcctgtgcggtgggtcacccgacccggagtagcgtgcgcctcgaaccgctgaggaggcgtaaggaggcgcggacccatggcgtatgacgaggcgaccaccgatccggccgcatatcggcgccgcgtccagctcgacgacaccgccggcggtggcaacaccctcgaccagtcgctgtccgccccggtccccgccccgcccgtcgccgacgacggccgtgaccgcctcggcatccacctcggttgggaggtcgtcctcctggtcgtcgccgcggtgctcggcttcctgctctggcgggagagttcggccgccttccagcgtcccgccctggacggcctgctggtcaccgcctccgcgatcggcctggtcacgctcggcgccggcctctcgctgcgcgccggtgtgccgaacctggcgatcggcccgatcgtgctggccgccgagttccagttcgccgagaacggtgacaagggcctgctcgagtccctggtcccggcgctgctgatcgcggccgccggcggtctgatcgtcggggtgctgatcctcgtcctgcacgtgccgggatgggcggccaccctggcggccgcgctcggcgtgatcaccttcgaccagctgcgggtcgacgcggtcgcggtgcagggcacctgggagccgaccgaccgggccttcctgctcttcggcgggttcgcgatcctggcggtgctcggcgccggcctgggcgcgatcggcccgatccgccggttcttcggccggatgcgcccggtcggtgacccggccggccggcgtggcgccgcggtggtgctgccggtgctggtcgcgctgatcgtctccacggtcttcgcggccggggccggggtgatcatggccggtcagtccgccgggccgatccgacccggcaccggtctggagtggaccggcatcggcctggggctggcgctgctcggcggcaccagcgcgttcggccgccgcggcggcatcttcggctcgctcttcgcggtcgtcgcgctcaccctgttcctggactaccaggcccgccgggagctgcacatctcgctctacgcgaccgccggcgtgatcttcctggccggactgatcgccacccgggtggtcgagtcgtacggtcggctggcgagcgccgcgcgcaccaccgactggaacgccgcgccctccggcggcctcggcacgaactggtcgcccaccgccccggagacctggaacactccggccaccccggtgggcaccgaccgttgggacgacggaccgtggggcgccacccgctgaacgtatgctgtcggtcatgaccacgcacggcttcgccgaactggacgctctgcccaccgaggagctgcgggaacgcgctttcgccaaggctcgggagaagcacgacgtccgcttcttctggtcggtgctcaagcacctgccggacgccgacgacgccgccgggctcgacggcgcgccgaactcgatcggcccgaccgtcgacgaggcggtcgcgctctggcgcgagctggagggccgtgatctgggcgagcgggagccgttgttgcgtgccgctttcatcgactatctgtcgaggtagtgacagtcgtcgtttgagtcggtggtcccgccgggaatcagggaccatggctctcgaaagcaggtacaagaccgcaaccggggcgggcacgctcgctgcgttcctgctcgtgctgatcttcggcagtccctggtacggggactgggtcaccgacgccgtcgacgggcgcaccggcgccggctggtggcttcatctgctgcactggccggcctggaagttcgacagctcggactcgctgcgcggcgtcatcgtcggtgatctccgggcgatcctggcggtcgtcctgaccctggtgttcctggtgctgctgcccggcacccagctggcccgggcccgcggcacgatcgcccagctgctggccggctgggcggcgtacgtcttcgcgggcgccttcgccgcgctgatcgccgtcctgttcgtcgccgaccccaccctgatgagcatcttccagaacagcggcgccggcgccgagtacggcatgttcgtcggctggatcgtcggcctcgccaccctgggcggtcgccggggcacggccggctgacccgtacggcagccggtggtccaggtccgattgcggtggtacgtcgtgagccccgcccgccgcgccacgaccggccgcgccggctgccctagaccgcgctctgggccggtgcctcgaacaccgcggtcctggtgacctgaccgaccggctgaccgttctcggtcaccaggaccgtgctcgcattctcggtgagcatcacggccagggcgtcgtgcagggtggccgcggcgtccacggcgggcagcccgtcgacggcaccgacgggcgccgacatcacctcccgtaccggggtgaccgcgagtcgccggatgccgcggtcggcgccgacgaagtcccggacctcggccgacgccggtcggctgagcagctcggcgggcggcgcgtactgcagcagacggccgccctcggccagcaccgcgatccggtcgcccatccggaccgcctcgtcgatgtcgtgggtgaccagcacgatcgtcttgcgcacggtggcctgcaggcgcaggaactcctcctgcagccgggcccggacgatcgggtcgaccgccgagaacggctcgtccatcaacagcaccagcgggtccgcggcgagcgcgcgggccaccccgacccgctgccgctgaccgccggagagctcgtgcgggtaccgcttggcgtaccgcgccggatccaggccgaccaggtccagcagttcgtcggcgcgggcggtgatccgcctgcggtcccagccgagcagcttggcgaccgtgccgacgttggcccggaccgtctggtgcgggaagagtcccacattctggatgacgtagccgatctgccggcgcagcctcaccgggtcctcgccgagcacgtcgcgcccgtcgatggtgatcgtcccgcgggtcggctcgatcagcctgttgatcatgcgcaggatggtggacttgccggagccggaggcgccgatcagcacggccagctcgccggcgcgcacctcgaggctgaacctgtcgacggcgaccgtgccgtccggatagaccttgccaacgtccgccagggtgatcgatgccgcggtagcgtccacgtatgtccttcctgtcgtgggtcccggcatcgccggcgcttgccgcaccggccgatgacggcccggggaatccgtggttctcctggcggtacgtccatgagaacgccgacgccatcggcaccgccctgcgtttccacgccgggctgaccgcgcagaccgtgctggtcgcgctggtggtcgccgtgccgctggcggtcgtcgcctactggatcaaaccgctgaccgcgccgattctcgcactctccggcgttctctacacgatcccttcgctggccctgctgtcgctgctggccccgctggtcggcaccaccagcaccacgtcggtcctgatcgccctggtcctctacgccctgctggtgctggtccgcaatgcgctggccgggctcacccaggtcccgcccgaggtcatcgacgccgcgaccgggatggggtacggccggttcggccggttgctgcgggtcgagctgccgctggcgctgcccggcatcctgaccgggctgcggctcgccaccgtctccactgtggcgctggtcacggtcggttcactgatcggacagggcggcctcggcgatctgatcctcggcggtttccggaacaacttctacaaggccgagatcctcaccggcaccatcctctgtgtgggcctggcgctggtgctcgacctgctgctggccgggctgggccggctgctgacaccgtggacccgggggcgcgccgcatgagctacttcaacgagggcatcgtctggctcaacgacccgctgaactggaccaacccgggcggcatggtcgaccggctgaccgagcacctggtgatcagcttctgggcggtcctgctgggctgcgcggtcggctggccgctcggcatctggctgggtcaccgcggacgcggcggcggcccggtgatcaccgcggccaacctgaccctggccgtaccgaccctggcgctgctgaccatcctgccgctcaccccgctgggcttcggcaaaccgccggtggtggtggccctcgcggtcttcgccgtgccaccgctgctggccaacgcgtacaccgggctgcgctcgatcgacccggagaccagggaggcggcccgcggcatgggcctgtccggcgggcagctgctgcgccaggtggagctgccgctcgcggtgccctacctggcggccgggctgcgcaccgcggcggtccaggtggtcgcgaccgcggcgctggccgccctggtcaacggcggcggcctgggccagatcatcagcgccggcttcggcatcgggatgagcaacggcggcggcggtcagatcgtggccggcggcctcgccgtggccctgctggccctgctcgtcgagggcctgctggcgctcctgcagcggctggtcacgccgcccgcgctgcgcacccggaagcgtcgtcgcagcgctgtgacggtaaccacgccataacgctcccgcaacagaagccgatcttgtcatacccgcttgctaggaatgactcagcattacgcgggcatcgcaccttgactgcccgtcggacacgcggcaccgccatccgggcggcgccggggcacagaaggcggcagtaatgcgtaacaacattttccgcacggccggcgttctcgccgcggccgtcgtcgtcctggccggctgcggcaaggccggttcctcgggcaccgaggctccgccgtcggcggccgccgcggccggcgccgggtgcgccccggtcgcgggcgacaagctcgtggtcctgaccgacgacaagaaactgcagaacaccgacaacgtcatacctgccatcaacaagaaggcggccaccccggagctgatcgccgcgctggacaaggtgtccaccgcgctcgacaccaccaagctggtccagctgaacaaggcggtcgacatcgaccgcaagtcgtccaaggccgccgcgcaggacttcgccacggcgaacaacctgaccgcgggcatcaccaagggcaagggcggcaacatcaccgtcggcgccgccaacttcagcgagaacgccacgctcggcgagctgtacggcatcgcgctgaccgcggccggctacaccgtcaaggtgcagcagatcggcaaccgcgagctctacgagccggccctggagaagggcgacatcaccgtcgtcccggagtacgccgcgaccctggccaccttcctctccggcaagatcgacggcaaggccgccaaggacccgtcgtcgcccgagctggagaccacggtcaccaacctcaaggcgctcggtgacaaggccggcctgagcttcggccaggccagcaccgcgcaggaccagaacgcgttcgcggtcaccaccgccttcgcccagaagtacaacctgaccacgctctccgacctggccaccaagtgctccggcgcggcgaccgtgctgggcggcccggccgagtgcccgcagcggccgaagtgccagcagggcctggtcgcgacgtactcgttccaggccggccggttcgacacgctggacgccggtggcccgctcaccaagaacggcctgaagcagggcaccatctcggtgggcctggtcttcagctcggacggcgcgctcgcggccggctgacacccgcacgtccgaccgaccgaacgccgggttggcgtgtgccacccggcgttcggccgtttcgtcccggacgcactctcggtaacatctgcccccatgccggaacgcgactccccagcgggacacagcgcacgcctgctccgcggcctcctctgggcgggggtgatcctcgccccggtggccggagccgtcgtgctgctcggcggcaccggcaactcggtccgcttcgggatcctgctgaccgcggtcagcgtcgtcctggtcggcgcttcggtcctgatccgcagcgatccggtgctgctgcgcatcgacgtcgaggaccgggtcgccgaggaggtcgaccggctccgccgcgggctgatcaccgagctcgccgggcacgcgtccgcggcgcccgacccgaaccggccgccgctgaccgagcatagggcgccgggccggcccctggcgatcgatcgcgatcagcagccgggtcacgacggtgagcacaccatgggattcgggccgaacgggcggggacggcagggcaacttcgtcgaacagcccggcttcgagacgccgcccgccccgcagaacgtccctgccccgcagggcttcgccggcccgcacgatttcgccggcccgcagggctttgacgagccgaccacctacggtcccggcccgcaggggttcgactccggattcgacgagcagcccagcggcttcttcgacgactacgcccagccggacgacggcccccagcacgcccccgagccgcccctgcccccgcgcccggccggcggccgcgccgtcgctagctagctagggagcgggcgcggtctacggctccggtggccacccggtcacccgccccgcccccgcctacggccacccggaagctgtgaacggcgacttcggctacgcaccgcacgacaacggctacgactacggtcccgacgacggcaacggctacggcccgaagtacggcaccggctacggtcccgacgacggcaaccgttacggcccgaagagcggcaccggcttcgaacccggcaccggcggcttccgccccacccccgacgaccccgcccagtaccaggcccgccgccaccgcccgtcagccaacgacaccaacgtcggctccctcgccgacttcgcgaacatgcccggctaccgcgacgaggcccccggcaactggtgaccgccccgccctacttgtcgatgtccccgaccacgaagaacatcgaccccaggatcgcgatcagatccggcaccaggcagcccgggatcagcgtcgccaacgcctgcacattcgcgtacgacgcggtccgcagcttcaaccgccacggcgtcttgtccccccgggacaccaggtagtacccgttcaccccgagcgggttctcggtccacgcgtaggtgtgcccctccggcgccttcaccactttcggcaggcgcacgttgaccggcccgccgatccgctccacccggtccaggcactggtcgaccaggtcgagcgacgcgtacacctgatccagcagcacctcgaaccgggcgtgacagtcacccgcggtccgcgtcaccacgggcacgtcgagttggtcgtacagcagatagggctcgtcacggcgtacgtcgaaatcgagaccgctcgcgcgggccaccggaccggaagcaccgtaagcggcggcgtcagccgccggcagaacaccgacccccacggtccgggccaggaagatgtcgttgcgccggatcacgttgtccaggtcgggcatccgcttgcggaccgccgccaccgcctgtcgcgcccgtttcgtccacccggccgggacctcctccttcagcccgccgacccggttgaacatgtagtggatccggccgccggagacctcctccatcaccgcctgcaacgtctcccgctcccggaacgcgtagaacatcggggtgatcgcgccgatctccaacgggtacgacccgaggaacatcagatggttcagcacccggttgagctcggccagcgccatccgcagccagatcgcccgctccggcacctcgatgcccatcagccgctcgacggccagcaccacgcccagctcgttggagaacgcggacagccagtcgtgccggttcgccagcatgatgatctgccggtagtcacgcacctcgaacagtttctcggcgccgcggtgcatgtaccccacgatcggctcgcaggtcaccacccgctccccgtccagggtcaacttcaaccggagcacgccgtgcgtcgacggatgctgcggcccgatgttgagaaccatgtcggccgtctccagccccgacccggtccccaccgtcatctcacgcagcgcatccgtcacagacgaatggtcgcacgcccggcgctcagccgaggggaaggtcgacgccgatcggatgccacagccaccagtgcgcgccgagcccggtcggtgacctcagctcggcggcttcgccggccgccgacagggcgcgcaggtagcccaccggatcgctgctcgccaaggtcagcggtggtcgcccgccgctgaccccgagcggtccgagggccctccgctggctgaccatttcgtacggcgtaccggtggccgccgcggccgcgtccaccgccacgtgcgcggtcacgtcgcaactcccgtccgggaccgggggaatctgccgcccgccgcggaacccggtgatcgtgcccagcaccggccgctcggcccgccgatggccgtagtcgacgcagagcgccgctccgcgccgcacccgctccaccgcgcccgcccaggcggcgtcccgcggcgcgccgacctcgatccgcccggggccgggccaccaacggctcgcccagaagacctccgcgggatcggccgggccgcccagcgtctcggcaccggtgcgccggtcgaccagaaccttgcgcagccgaccctgctcgtcagtctcgacgacgtcgagcgggacgttgtccagccactcggtggcgaccagcagcccggtgatgtcctccgggaggtcgtgccgccagcggatgcccggatccagggagtcgggtcgcggcgcccgctccacggcgaccgggcggacccgggccgcgaggccggcgggcagcatcaggccgatcgtggtgagcagctcgccgcggccggcgccgacatcgaccagatcgagacggtccgggtggccgagcgcggcatcgacccgctcgatcaggcggaccagggcgccggcgaacagcggggaggcgtggacgctggtgcggaaatggtcggcggggccggtgcgggggtgcacgaagaagccgtccggcccgtacagggcggactccatggccagccgccacccgattccgctcacccgatcagcctaggggctcagtgggttgccggcccgtccgatacatcgggggagcgtcggtgcggttgttcacaggcggttgccacccgtgtgtcgcgacagcgcatactggcgctcgaccggtaccccgactcgaggactggatccatgaacgtattgaccgtcggcgtgatcggcgccgggcgggtgggtgctgtgctgggtgccgccctgcagcgcgccggccatcgggtggccgccaccgccgccgtctccgccgcttcgcgcgagcgcgccgggctcctgttgcccggggccgcgatccttccggccgacgaggtcgcccgggcggccaccgacctgctgctgatcgccgtgccggacgacgcgctggccgctgtggtggccgggctgcgcagcaccggagcgctccgtccggatcaggttgtggcgcacacctcaggggctcacggactcgacgttttcggcgatgtgaacggcatggccctgcatccggcgatgacgttcaccggcaccgcggccgatctggcccggctgcccggcatcgcgtggggcgtcaccacccgcgaccgggcgttcgccacccggctggtcgccgacctgggcggcgcgccggagtggatcgccgaggacgcccgcccggtctatcacgcggccctggcgcacggcgcgaatcacctggtcaccctggtcaacgaggcggccgacacgctgcgcgcggcgggggtgcgcgagcccggccgggtgctcaccccgctgctgaccgcggcgctggacaacgcgctgcggatgggcgacgcggcgctgaccgggccggtctcccgcggggacgccggcacggtcaccaagcatctcgaacggttgccggctgccgtcgtaccggcctatctggctctggcgcggcgcaccgcggaccgtgccctcgcgtccgggcggctgcggctgcaggacgccgcggccctgctcgaagtcctgcatccggcgaacgagacggcgaacgagacggcgaacgagacggcgaacctgacggcgaacgaggcggcgaaggtatgacccaggtggtgcacacccgcgacgcgctggccgccgcgctggccggggccgacgagatcgccgtcgtgatgaccatgggcgcgctgcacgaggggcaccggcagctgatccgggtggcccgcgagcgtgcccccttcgtcgtcgtgacgatcttcgtgaatccgctgcagtttggcccgaacgaggacttcgagaagtatccgcggaccctggaggaggacctggcggcgtgccgggcggagggcgccgcggtggtcttcgcgccgggccgggacgacgtctatccggacggcccgccgtcgatcacgatgaatccggggccgctcggcgagatcctggagggtgccagccggccgggacacttctccggcatgctgaccgtcgtcgagaagctgctccggctcacccgcgcggacgtcgccttcttcggggagaaggacttccagcagcttgcgctgatccggcggatggtggccgatctggagctcgatgtcgagatcgtgggcgtgccgaccgtacgggaaatcgatggtcttgccctgtccagccgtaaccgctatctcggcgccgccgaccggacggccgcgctggcgctctcccgcgcgttgcgcgagggcgccgcgcaccacgaggccggtgcggtcctggccgcggcccacaagatcttgcaagacgagccggccgtacgcgtcgactacctcgagttgaccggcgccgacctgggtccggtgccggcggacggcccggctcgcctgctggtggccgcccgggtgggcgccacccgcctgatcgacaacgtcccgattgttctccggaaggatgcctgatgctgcgcaccatgctgaagtcgaagatccaccgggccaccgtgacgcaggcggacctgcactacgtgggctcggtgacgatcgacgaggatctgctggaggcggccgatctgctgcccggtgagcaggtggcgatcgtcgacgtgaccaacggcgcgcggctggagacgtatgtgatccccggcgagcggggcagcggggtgatcggcatcaacggcgcggccgcgcacctggtgcaccccggtgacctggtcattctcatctcgtacgggcagatggacgacgccgaggcccgggagtaccggccgcgggtggtgcacgtcgacgcgcagaaccgggtgatcgagctgggcgcggacccggccgaggcggtcccgggcatggccggtgacctggtgcggggtgatctgaccctggcaactcgctgaatcttcccgaacgccgccgatgaaccgtactgatcaccatatgatcgataaatcggacatcggcggcgggcgggagggcccctcatgcgagactggcgtgcccggctccggcgcgcccgatcgggccccggcctgggcttcgatctcgccgccacactgggcgtgatgctgctcgccgcggccgggtgcggcaaccccggcaccgtcgacggcgacctcaccaacaactggggcgcgatggccccggccaccggcttcgagccgatcgcggacacctgccacctggcgaacttcgcggcgaccggcccgcgcgcgacctatgaggaggtcgactgcgcggtgcggcaccgcaccgagacggtgtacgtgggcacctactccggggcggccgccgacgccgagcagccgccgtcggagtcctcggccggggcgcgtgcggcttaccacacctgcgacgagaagacgaccgcgtacgtcggcgccccctggcgtaccgcccggctctggatcggggtcacccatccctcaccggccgcctgggcggggggctcccgctggttccgctgcgacgtggtggaactcgactcgatcgaggacgacggcgccctggtgcagcgcgcgggcagcctgcgcagcgtgctgagcgccccgtcggacctgctgctgggctgttacgcgatcaagctgagcgacagcggggcgatcgacaccatgccgccggccccgtgcaccgccgcgcacaacgcggagttcgccggggtgtgggacgcgccggccgacgccacctatccccaggggaacaccgcgtggaagaggttccacgacggctgccggacggtggtcgccacgttcgccggggttcccgacgacaagaacctggagtaccgcaccggcgtggtgtcgctgcccggcaacgccgacgtctgggcgcagggcgaccgcggcgtgcgctgttacctgtggctggacggggcccggctgaccacttcgatgcgggccaaggggacgaaggcgttaccggtccaataccagtgatgagtaacggtgaccactgatggtgcccccggcgtgaccggtgtgcaggggcggagtgtactgaccacatgtcacctctcgcggatctaccggccctgccgcgccggctcgcggccgccgagcccggctggaccgagaccaccgacgtggtggtggtcgggtccggcgtcgccgggctgaccgccgcgctgcacctgcgggagcagggcctgcacgtcacggtggtcaccaaggtcaacatcgacgacgggtccacccgctgggcgcagggcgggatcgccggggtgctcgatccgctcgacacgccgcaggcgcacgcgtacgacacggagatcgccggtgtcggcctgtgtgacccggacgcggtgcgggtgctggtcgaggagggcccggcgcggatccgggagctgatccgccggggcgccgaattcgaccgcaacccggacggctcgctgatgctgacccgggagggcggccaccgggccgaccggatcgtgcacgccggcggcgacgcgaccggtgccgaggtgcagcgcgccctgcacgccgcggtccgccgcgacccgtggatccgcctggtcgagcacgccctggtgctcgatctgctgcgcgccgcggacggccgggcctgcgggatcaccctgcacgtgctcggcgagggctcggaggacggggtcggcgccatcctggcccgcgcggtggtgctggccaccggcgggatgggacagatctacgcgtccaccaccaacccgtcggtctccaccggcgacggcgtggcgctcgcgctgcgggccggcgcggcggtcaccgacgtggagttcgtccagttccaccccacctcgttcgtcacggccgacctgagttcggtgcagcggccgctgatctccgaggcgctccgcggcgagggcgcccacctggtcgacgaggccggtacccggttcatggtcggccagcacgagcaggccgagctggccccgcgggacgtggtggccaagggtatctaccgggtgctgcgggcgaccggggcggaccacgtctacctggacgcccggcacctcggcagagagtttctggagagccgcttcccgacgatcatggcgtccacccgggcggccggggtcgacccggccaccgagctgatcccggtcgcgccggccgcgcactacgcctccggcggcgtgcgcaccgacctgcacgggcggaccagcatcgccgggctctacgcctgcggcgaggtggcctgcaccggcgtgcacggcgccaaccggctggccagcaactcgctgctggagggcctggtgttcgccaagcggatcgccgacgacatcggccgcgacctgccggcccaggccgacccggtgcgtgtcaacatgacccccgcctgggtcgccgacgcgagcgtccgcgccgaggtgcagcggaccatgacccgcggcgccggcgtgctgcgtacgggtgactcgctggacaccgcggccaaggaactggcccggctggccgagtcccgggccaccccgaacaccgcggcgtgggaggcgaccaacctgctcaccgtcgccaccgcgctggtcgcctcggcccgcacccggcgggagacgcgcggctgccactggcgtgaggactatccgaccgcggccgacgagtggcgcggccacctgctcgactcgattgcttccgacggcagcatgacccaggacttccaggagatggcgtgatcgacttcgggttggacttcgcggaggtccagcggattgtgctcaccgcgctcgccgaggacctcggcgacccgccgcgcgacgtgaccagcgaggccaccatcccggccgaccaggtggacacggccgaactggtggcccgcgcggacggtgtggtggccggcctcccggtcgccgccgaggtcttcgcggtcacctcgcaggggcgcgccgagttccggcagatcaccgccgagggcgaccgggtgacccggggcgacgtgctggccgtcgtcaccggcccgacccgcgcgctgctcaccgccgagcgcaccgcgctgaacctgattagccggatgtccggggtggccacgcacacccgccgctgggccgacgagctgcggggcacccgggcgacggtgctggacacccgcaagaccacgccggggttgcggtcgctggagaagtacgcggtccgggtcggcggcggcaccaacaagcgcatgggcctgtacgacgtcgccatgatcaaggacaaccacaagctggccgcgggcagcatcaccgcggcgtaccgcctggtccgggagacgttcccggacgtggcggtgcaggtcgaggtgaccacgctggccgaggcgcaggaggcggtggcggccggggccggcttcctgctctgcgacaacatgagccccgagctgctggccgaggtggtcgccgcgatcggcggccgggccgagctggaggcgaccgggaacctgaccctggccaccgccgcggcatacgcggcgaccggtgtggactacctttcggtcggcgggctgacacactcctcaccgatcttggacatcgcgctggatctgcgaccccgctgatcgcgacgcccgtacgacctgggggaacccgtgctgctttgcatcgacatcggtaacaccaacaccgtgctggccaccttcgacggtgacaagctggtgcacaactggcggatcaagacggacgccgcctcgaccgcggacgagctgggcctgatgttccgcgggctgctggccggcgacgcggtggagatcaccggggtggccgcctgctcgaccgtgccggccgcgctgcgcaacctgcggaccatgctgaagcggtactacggcgacgtgcccagcgtgatcgtcgagccgggggtcaagaccggggtgcagctggccatcgacaacccgaaggaggtgggcgccgaccgggtggtcaacaccctggcggcgcacgccctctacggcggaccgtcgatcgtggtcgacttcggcaccaccaccaacttcgacctgatcagcgcgaagggggagttcctcggcggcgcgttcgccccgggcatcgagatctccttcgacgcgctcgccgcccgggccgcccagctgcgcaaggtggagccggccaagccgcgctcagtgatcggcaagaacaccgtggagtgcctgcagtccgggctctactacggtttcggcggtcaggtggaccggatcgtcgagcggatgatcgaggagatcggcccggtctccgcggtgatcgccaccggtggcctggcctggctcgtcaaggacgagtgccggacgctgaccgcgcacgagccgatgatcacgctgatcgggctccggatggtatatgagcggaacgtctgaaccgggctgagtaggctttccgggtctccaccaagcccaccaccacacaggaagaccgtgccgtgaccgagcagaacgtgccagtgaccgaccccgccgacgaccttcccgagcagatgaaggtccgccgggcgaagcgggaccggatgctggccgacggcgtcgcgccctacccggtcaccgtcgcccggacgatcagcctggccgagatccgcacccggtacgcggagctgccgaccgacaccgccaccggcgaccaggtgtcggtcaccggtcgggtgatcttcatccgaaacggtggcaagctgtgcttcgtgaccctccgcgagggtgacggcaccgagctgcaggcgatgctctcgctggaccgggtcggcgcggagcggctggaggactggaagcgcctggtcgacctcggcgacctggtggcggtcaccggtgaggtgatcaccagccgccgcggggagctctccgtgctcgccgattcctgggcgatgagcgccaaggcgctgcgcccgctcccggtcgcgcacaagccgctttccgaggagacccgggtgcggcagcgttatgtcgatctcatcgtccggcagcaggccagggatacggtgcgtactcgcgcaaccgtgatccgtagtctccgcgagtcactgttccgccgcaattatctcgaggtggaaacgccgatgttgcagttgctgcacggtggcgccgcggctcgcccgtttgtgacgcacagcaacgcactggacactgatctttatctgcggatcgcgccggaactgtttttgaagcgggctgtggtcggcggcatcgaccgggtcttcgagatcaacaggaacttccggaatgagggcatggactccacgcactcgccggagttcgccatgctcgaggcatatcaggcgtacgccgactacaacgtgatgcagatccagacgcgggagtggattcaggaggccgcgcaggcggtcgccggttcgcacgtggtgacccacttcgacggcaccgagctcgacctgggcggcgagtggcgccagatcaccctgttcggcgccatctctgatgcgctcggcgaggaggtcaccatcgcgaccgacctggcccagctccagcggtacgcggagaaggtgcagctcggcgtcgaccccaagtggagcgccggcaagctcgccgaggagctcttcgagcacctggtgcagcacaccctgcagcagccgaccttcgtccgggactatccggaggagaccgcgccgctgaccgcgccgcaccgggagacccccggcctgaccgagaagtgggacctctacgtcggcggtttcgagctcgccaccgcctattccgagctggtcgatccggtgatccagcgggaccggctgcacgcgcagtcgctgctggcggccggtggcgacgccgaggcgatgcagctcgacgaggatttcctccgggccatggagtacggaatgccgcccagcggcggcatgggaatgggaatcgaccggctgttgatggcgctcaccggcctgggcattcgggaaaccatcctgttcccgttggtccgcgcggagtagccgaacatcaattattgcccccgccattgacgggcgatgtccccctggcgttattgttcttccattgcgtgggagagtacctgtgttcgggaggataacggcgcgtggccaagcagatcattcacaagctggtcgatgacatcgacggcggcgacgcggacgagacggtgaagttcgcgctcgacggtattcagtacgagatcgacctctcggagaagaacgccgccgaattgcgtgaggtcttcgcgcagtacgtcggcgcgggcaccaaggtggcccggggcggtgtggtcgtcggcggccgcgcggctcgtggccgcggcggcgcggccgctgaccgggagcagaacaaggcgatccgggagtgggccaagaaggccggttacgacatctccgaccgcgggcgcatcccgcaggagatcgtcgacgagtaccacgcgaagggcccgggccgggcctgagctttcgacgaagagggcgtaccgatcatcggtacgccctcttcgtgcttccagtaccgttatccacaggacagacgaggttgtccacaggctgtggaccgtgcggatttcgctgtccgcgtacacgttcgggtgggggaacagccgctgagcgtgcgaagttggctaaatcaacgtcgcggatcgtttcgaggggctgcgagggcccagcggatcctcccggcggcgatagagttactgcacgggtatcaccggtacccgtgcgctggccccgccagctgttgagacaggctcagcattggcgcacggcacgtgaggagcacgagggcatgttcgagcggttcaccgaccgagcgcgacgggttgtcgtcctggcccaagaagaggcccggatgctcaaccacaactacatcgggaccgagcacatcctgctcggcctgatccacgagggcgagggcgtcgccgccaaggctctggagagcctgggcatctccctcgagggcgtccggcagcaggtcgaggaaatcatcggtcagggccagcaggcgccgagcgggcacatcccgttcacgccgcgggcgaagaaggtgctggagctctccctgcgggaggcgctgcagctcgggcacaactacatcggcaccgaacacatcctgctcggcctgatccgcgagggcgagggcgtcgccgcccaggtcctcgtcaagctcggcgccgacctgaaccgggtgcgccagcaggtgatccagctgctctccggttaccagggcaaggagccggccgccgcgggcaccgccaccggcgaggccgcgccgtccacctcgctggtcctcgaccagttcgggcgcaacctcacgcaggccgcccgggagggcaagctcgacccggtgatcggccgggagaaggaaatcgagcgggtcatgcaggtgctctcccgccgcaccaagaacaacccggtgctgatcggcgagccgggcgtcggcaagaccgccgtcgtcgagggcctgtcccaatccatcgtcaagggcgaggtgcccgagacgctcaaggacaagcagctctacacgctcgacctgggcgccctggtcgccggctcgcggtaccgcggtgacttcgaggagcgcctgaagaaggtgctcaaggagatccgcacccgcggcgacatcatcctgttcatcgacgagatccacaccctggtcggcgccggcgccgccgagggcgcgatcgacgccgcctcgatcctgaagcccatgctggcgcgtggcgagctgcagaccatcggtgcgaccaccctcgacgagtaccgcaagcacctggagaaggacgccgcgctggagcgccgcttccagccgatccaggtcggcgagccgtcgctcgcgcacaccatcgagatcctcaagggcctgcgcgaccggtacgaggcgcaccaccggatcagcatcaccgacgctgccctggtggccgccgcgacgctggccgaccggtacatctccgaccggttcctgccggacaaggcgatcgacctgatcgacgaggccggcgcacggatgcgcatccgccggatgaccgcgccgccggacctgcgtgacttcgacgagcgcatcgcccaggtgcgtcgcgacaaggagtccgcgatcgacgcgcaggacttcgagcgcgccgcccagctgcgcgacaaggagaagcagctgctcggccagaaggcccagcgggagaaggagtggaaggccggcgacctcgacgtcgtgtccgaggtcgacgacgagcagatcgccgaggtgttgggcaactggaccggcatcccggtctacaagctcaccgaggaggagacctcccgcctgctgcgcatggaggacgagctgcacaagcgcgtcatcggccaggaggacgcggtcaaggccgtctccaaggcgatccggcgtacccgtgccgggctgaaggacccgaagcgcccgtccggctcgttcatcttcgccggcccgtccggtgtcggtaagaccgagctgtccaaggcgctcgccgagttcctgttcggcagcgaggacgcgctgatccagctggacatgtccgagttccacgaccggtacacggtgtcccgcctggtcggtgcccctcccggttacgtcggctacgacgagggcggccagctcaccgagaaggtgcgccgcaagccgttcagcgtggtcctgttcgacgagatcgagaaggcccacccggacgtcttcaacacgctgctgcagatcctggaggacggtcgcctgaccgacggtcagggtcggatcgtggacttcaagaacacggtcatcatcctgaccaccaacctcggcacccgggacgtggcgaaggcggtgtcgctgggcttccaggcctcggaggacaccgagagcaactacgaccggatgaaggtcaaggtcaacgacgagctgaagcagcacttccgcccggagttcctcaaccgcatcgacgacacgatcgtcttccaccagctgcgcgagcaggagatcctgcagatcgtcgacatcttcaccgcgcggatcgagggccagctcaagaacaaggacatgggcctcgagctgaccgacaacgcgaagaagtacctcgcgaagaagggcttcgacccggttctcggcgcccggccgctgcgccggacgatccagcgcgagctggaggacacgctgtccgagcagatcctcttcaacgagctgcgccccggccagatcgtggtggtggactgcgagggcgacccggccaacgtggagaagtccaagctggtcttccgcggcgcggagaaggcgggagccgtgcccgacgcggtgccggccgacctcggcgcgaccaccagcgaggagtgacccgctgacatcgcggcccggccccttcccgggggtcgggccgttgtcatacccgggtatgacggtcggtgggcaccggagggtgacgcggccgggccagcctcatccatatcttccgatgcatgagagcgcgtcgcatcggtcaagccgtcttctactccgccgggctcggcccggtcagcgcggccagcctcgggctggcggtctccggccgctcggcggccgccgaacacctgtccaccgggtggcagagccgcctcggcccgccacccgcgctacgcggccggcccggtccggtcgtcgccaacgcgctgctgggtctgctgctgggcctgctggcgttgattccgctggctctggaggccgatttcgtggcccgcggcatcctctacggctgggtcgaccgcggcccctacgacacctcctggggcggccccggccgcggcggcgcctgggcggtgcacttcctggtcggcgtcccgatcgcggtggccggcatcgccgccctgatcggcctggcggccatgcaccgccgctggaccgcccgcctggccggcgagcccggtggcgcctgggtgcttccggtcgcactgctcggcacggccgccgaggtcgccttcgttattgcctttctgcgccagatctgatcggccaggatgagcgacatgcacgagatccgcgccgtctacgacgagcacaccatcaccgtctaccaggcgtattcgccggcgatcgcggtcccggcggtgcgcgccggacgattcgtgcccccgttcaagcgggagcggatgacctggatcaagccgtcgttcctgtggatgatgtatcgctgcggctgggccaccaaggagggccaggagcacgtcctggcggtctcgatcacccgcgagggcttcgagtgggcgctgacgaacgcggtgcacagcagttacgtgcggggggagtatccgagccgggacgactggcagcgcgagttgcgacgggccccggcccgggtgcagtgggatccggagcgggatctgcggttgcgggcgctgccgtaccggtcgctgcagctcgggctcggcggggaggcggcgatccgctacgccgacgagtggatcaccgggatcagcgacgtgaccgaccgggtccgggagatccgcggcctgctggacgccgggcaggacgcccgggcggcggagctgctgccgcccgagcatccctaccccgtggtcagccgcacaccgacggatccgcgtacgggctcctgacgacggtccggcacgggccggcggcgatcgggtgccagcggtgctgggccgggttccactgcatgatgaaggtggtcttggcgccgtcgatcaggcgctgcaccgcgtacttgccgccgcaggccagttcctgcacgacgtcgtcggacgccaccttgtcggcgtactggccggcctcgatcgcgtcgatggtctcggtgttgccggtcgggcagggctgggccggatccacgccgttgcaggcgatccggaacttgctccactcgccgcggggcaggtaggaggtgcagtagtccccgctgccgctgccgatcacgacccacttccgggtggccgtgtcgtacttgaagacggtggcgccggggtcgctgttcttgaccttctgcacgtaccaggccgaggcccacccgtcgtggcattccaggtcgcgccacttgtcgcccggctggtaccaccggctgtcgtatgccttgaccgtgtcgatcagctgctgctgagtgaccgggcaaccccccgccgggctggccggcaccatcgtgtggtggtggggcgtgagcggttcaccgctggacggcgccggggacggcgaggtggtggctaccgatggctgggtggcgacgaccgggccgggcgcggagtcgcgggtggcgaccagggtgaacggggtcgcgatcgccaccaccgcgaccgccaccgcggcggaggcgacgatgcggttgcggcgggtgatgcgacgcgaggtggtcagcatccggtcgtgcagatccgcgttgccgccgtgtgcggagagctggtccatcgtctcccgcagtacggtgaagtcgtcgttcatcggtccgctcccttcatcgtgccggcgttgatcaggtccggggcgacctggcgcatccgcgtcagcgccttgctggtctggctcttgaccgtgccgaccgagcagccgagcatctcggcggcctcggtttcgctgcggtcctcgaagaagcgcagcaccagcacggctcgctgccgagcggtgagctgggccagcgccttgtgcagggcgatctgcaggctgacccggccggcgtggtcgctgtccgggtcagcccgctcggtgagctcgccgggcagcgactcggcgacccggcggcggcgccaccggctgacctgcaggtggtacatggcggtccgggtgtacgcctcgtagtgcccgtcatcgccgagccgccggaccgcacgatgggtgcgggccagcgcgtcctggaccaggtcctcggccaggtgccgatcaccggtcaggaggaaagccgtgcgcagtagcgccggcgtccgacttctgacgaagtcggtgaaccccgtggtttcactcacgacctgtcacacgccggcaccccggcaggggttgccgtcgatgtcaaagaatctgtcgatcgactttcggggcgtcgccggccagtacgaagtcctcgtgaccgagcggctcgaccaggccgtcctcgaccagaccggcgagcgcgcgggcccgctgcacctcgtcggcccagaccacgtcgaggcgctgccgggggaccgggccggtggcgtgccgcagcacctccaggagaagtccgcgcacctggcggtcggtgccggcgtaccgctgcggtttgcggctcggcccctccggcagcggctcgccggacagccgccacgcgcacacctcatggaacgggcaatcggcgcaccggggggcccgcgcggtgcagacgatcgcgcccagctccatgaacgcgatgctcgcccgggccgcccgcgccgaatcctcgggcagcagctcctccatggcgaccaggtcggccgtggtggtggccgggccggcgtccggcttgccctcgaccacccgggagacgacccggcggacgttggtgtccaccaccgggtgccgctgcccgtacgcgaaggtggccaccgcccgcccggtgtaggtgcccaccccgggcagcgcgagcaactggtcgagctgatcgggcacccgcccgccgtgccgctcgacgatcgcctgggcgcaggcgtgcagccgcatcgcccggcgcggatagccgagccggccccacatccggatcgcctcggactgcgggtcggcggcgagcgcggccggcgtcggccagcgggtcatccaggagcgccaggccggttccacccggaccaccggggtctgttgcagcatcacctcactcaccaggacaccccacggggtggtttcgggctgccgccacggcagatcccgggcgttggcgtcgtaccaggcgatggattcgtcggcgagagtcatagcagcccttactgtagataggtggacgagctcgggaccatcgccgccgtcaccgaggcgctgaccgcggccggtggtgacgtcaccggcctgaccatgcagctcaccggcccgctccagctgaccgcggagctgccgccgggccgggccgacgagctggcccagctgctcgcggtggccgccgccgagctgggtgtcgaggtcaccctccgacccgccgagccgggcggcgccgccgtgacggcatgagatcggtcactgtgccggaaagtcgtttctcgatgagtggccggtgggcacgcggttcaccagcgcggggcctatcactaacgaacaggtccgcgagttggtgtcggttgtccggcgcgtcgcgcgcgatgaccgtgggggtccgggtttacggtgggccacatcatgcgtacgacggttggtcccctctcacccgcggtctactggcggcggcgggcggtcgtgctcggcgccctgttgctgggcatcatcgtgtggttcgtggcgtgctcgcacgacgacacgaaaccggacaccaagaacgcggcctcgtcgtacccgacgcccgccccggcctcggcgacgcccaagtcgtcggtctccggcaagcccggtgacagcgacaacggcctgctcgcctcggcgccggccggcaacccggtctatccggacccggtgcagtcgcagggcaacaacggtgacagcggcctgctgcccgccaacggcggtggccagaacggcggcggccagaacggcagcgggcagaacaccaacgtcaatcagccggccggcaacgcgtgcgcggacaacgagatccaggtgacgccggtcccggcggccacctcgatcaagcgcggcgccaacctggcgatcacgttgcggatccgcaacgtcggcaaccgcacgtgcacccgcgacgtcggcgccgacccgcaggagctgtacgtcgaagccggcgcgcagaagatctggtcctcggacaagtgcagcggcgtgcacggcaacgacgtgcagacgttcaagccgggcgaccagcgcgaattcaacatcacctggaacggccaccagtcgacggcctgcaacggcgcgacggcgaccggcccggcgcccgcggccgggcagtactcgctgcgcggccgcctcgacgggctcgtcagccagccggtcgtcttgaccctgtcctgacgattggtcgcggcgctcgagctgtacctggacgtcgacgcgacgcggcgggtccggacgctgtggcgcgccctcgaggccgagggcattcccacgctcggatcgctgcacccgaggcaccggccgcacgtttcgctcgccgcggcacggaccatcgagccgtacgcggcggcagccgccctggacggcctgaacgtcggccgtgggctcagcgtgcggatggacttcgccggccagttcgtcgggcgggtgctctggctcgggatcaccatgacacccgagctgatggaccaccatcgcgccgtgcacgagcggctggcggcgggcggggtcgaggtgtgggagcactaccggccggggctgtgggtgccgcactgcacggtgtcgctgcgggtgccgaacccgatgatggccgcggcgatccggcgctgtctggagatcctgccactgagcgggacgatcaccggggcggcgatcgccgatcacgcgaacgacatcctgcacccgctctgacgcctgcggggcggatcacccgtacccggcaatcgggagaccgtcggcgacggcctcccgatgagcgcgtgacggtcaggcggtgaagcggcgcttgcgtgcctggcggccggcgacgaccaggccgccgccgaccagcagcaggccggtggcgtagaggccgagcgtgcccgcgttcgagccggtcagcgcgaggtcgccgccgggggtggtggcgccggcggtcggggtgacgagcacgcccccggaggcggacgggctcaccggggcggggccggtcggcgcggcaccggccgacggtgaggacaccggcgcggtggtgggcgcggacgtcggtgcgctggtgggggcgctcgtcggcacgctggtgggcgccgtggtgggcgccgtggcgggcgccgtggtgggcgtcgtggtgggcgtggtcggcgtcgggcagtcggccggcttcgacggcgtaccgatgctggtccggaagctgttgtcgcgaacggtgaccggcctgccggagtggtccgtgcggtcggcggcctggccggccttgacccggatccgctcgccaccggtcacgaacaccgcgtcgacaccggcgttcgcggcgttcgtcaggtggatgtgcaggacgccgtcgcagtcggtgctgaagctcaccgcggggctgggcgagcagacgccgtcgccgccgttgtaccaggccgcccggcccgaggagtgactgcccaggccggacgacgagccgagcttggcgttgccgtaccgggtgtcgttgccggtgatctcgttcagcacggccgcgccgaagaccgtgtcgacctgggtgaagcagcccggcaccgcgacgtgcagcgagacactgcgggtgccggcatcgatccgggcggtctgcgcgtcgtaggcgaactgcgggacggcgtacgacttcttcggcgccgtgtacgacaccagcgagaagtcttgcgactcaccgtcgcacagcggcatcagcgcggtgatcgtggcggtgccgccggggccgtcgaaagtgtgctggtaggtggcgtccgcggcgctcacgcaggaccccgccccgtgggcctcggcggccggcgacagcccggcgaacgcggcggtggcgatggcggcgccactgagaacagacatgacacggcgcatgacgaggcccctgactgtgcaatcgggtcgggggcggtctcaccactgactccccgggccgccatgcggtgaccgatctcttgcccggcccggatcctcgtctccccagatgctgggtgccgcggcgaggtctccgcggtgcgatcaggctagggcgcaccgggcggcggcggaaggggtcatcactttgagtaatgtcgaccatcgtggagtcgcgcctgaaacgtgcgttttacacaatgccgacggcgaaatgcccgatctcaaggtggtgcatgtcacatacgctgatcagcggtgacagagggtcattagacgtagcgctctaggatcgacgcctcggccagccgggacagaccctcacgcaccccgcgggcccgggcgtcgccgaccccctcgaccgcctgcagatcctcgaccgtggcgcccagcagccgttgcaggctgccgaagtgatccaccagccggtcgacgatctgggccggcagccgcggcaccttggccagcagccggaaaccgcgcggcgacacggccgcgtccagcgcgtccgaggcgcccggatagccgatcgccttggccaccgcgaccaggtcgatcatttcggtggcggtgagcaggtccagctcgaccagcgcctcgtcgagcgtgcgcgccttgcggccggtgggcaggtagtcccggatgaccagggtgcggtccgagtcgacgccggccatcagctcgtccagctggagggcgagcaggcggccgtcggtgcccagctccaccacgtaacccgagatctcgtcggcgatccggcggaccatctccagccgctgcaccaccgccacggcgtcgcggaccgtcaccaggtcctcgatctccagcgctgacagggtgccggacacctcgtccagccggagcttgtaacgctccagggtggccagagcctgattggcccgggacaggatggcggccgaatcgtccaggacgtgacgctgaccgttcacatacagcccgatgatgcgcatcgactggctcaccgagatcaccgggaagccggactgcttggccacccgctccgcggtgcggtgccgggtgccggactcctcggacgggatgcccgggtcgggcatcagatgcacggcggcccggacgatccgggtgccgtcgctggagagcaccacggcgccgtccatcttgcacagctcccgcagacgggtggcggagaactccacatcgagcgggaaaccgccggtgcagatcgcctccaccacggcgtcgtggccgagcacgatcagggcaccggtgcggccccgcaggatgcgctccagaccgtcgcgcagggcggtgccgggggccatcagggcgagattggcgcgcagcggatcgctggcgccaccggtgaggccggaaccggtcgccggggtcaccgcgcggtggcccgcgccgttgacgccgggccgcggcgatgaactggcggcggacttggaaccatcgcggtcgagcggcaccggtacagtctacgaactgtcatccggagcaacgaggcatggttcgatgaatgctccgtagcgtgatgaatcgtcactctcggtcaccgcccagggtcatcgggtggagtgatcggccgacgcccgcgccgcgctctgcagcgccgagcggagatcacccacctcgatcacctccatgcccctgggcgtgccgccctcaccggccgtgctgcccggcgggaccagcgccacccggaaccccagccgggccgcctcggccagccgccgaccgaccgcgctcacccggcggatctcgccggtcagcccgacctcaccgatcgccaccagggtcggcgccatcgcgagatccagcccaccggaggcgaccgccagcgccatcgccaggtcggccgacggctcggtcagccggatgccgccgaccgtcgccgcgaacacctcgcggttgtagagcttcaactgtttcgtccggcgctccagcaccgccagcaccatcgccagccgggcgctgtccaggccggagacggtgcgccggggggagccctgcacctcggccccgatcagcgcctgcacctcggtgacgagcgcccggcggccctccatggcgaccgtcacgcacgtgcccggcaccggctccagatagcgggtgaggaacaggccggacgggtcgggcaggctgctgatgccgccctcgtgcatctcgaagcaaccgacctcgtcggccgcgccgaaccggttcttgaccccgcggaccagccgcagcgacgaatgcttgtcaccctcgaaatgcagcaccacgtcgaccaggtgctccagcacccgcgggccggcgacctgcccgtccttggtgacgtgaccgaccaggacggtggcgatcccgcgctccttggcgatcgagaccagggcggcggtcaccgcccgcacctgggtcacgccaccgggcacaccctcggtgcccggagccgagacggtctgcaccgagtcgagcaccagcaggcccggccggaccgcgtcgaggtggccgatgaccgtgcccagatcattttccgcggccaggaagaggcgctcgtgcagcgcgccgagccgctccgcccgcaggcgcacctgactcaccgactcctcgccgctgaccaccagcgagggcgaaccggcgccggccgcccactgctgggccacgtcgagcagcagcgtggacttgcccaccccgggctcgccggcgagcagcaccaccgcgccgggcaccaggccaccgccgagcacccggtcgagctcaccgaccccggtcggcaccgccttggccggggcggcgctgatctgcgagatcggtttcgccggctcggacggcatgcgggaactgacgacccggccggagaccccgacggtcaccgtggactcgatcaccgagccccactcgccgcactccgggcaccggcccagccacttggggggctggtggccgcaggcgtcgcagacataggccgggcgggctgccttggaactggtccgagaggtcgtcacccggccaagttagccgccgggtacgacaacatcacccctcggtgttctcgttctccagaccgggggcccgggaggccgggctcagcgggaccgcgaccggcgcctgaatggtcaggtcgggcgtgccgttgctgaagtggaagaccaggttgaccgactcgcccgggcgcagcgcgtcggacaggttgaccacctggagcttgtcggcgtcggtcgagtggaacagggccgagccgagcggcttgatggtgatctgcgcggtggtgacggtcggagcggccggcacggccggagcggaggccgacgtgccgggcagggcgccgggaacctcaccgggcttggccgacgcgcccggctgggccgacgcgcccggctgggccgacgcgcccggctgggccggggccgagctagctagctaggaacggccgccgcggtggtcggcgcggccgccttcacgaagccgacctgggtgcccgagacgacctgcggccggttggccggggtgctgctgatcgacacggtgaccgggcttgccgtccggttgtaaaggttcagatcgagcggcgcgttctcgcccttggcgtagcccttgacgccgttgtaggccacctgcgcgttgcgcacggccacgctgacggtgccgtcggtggcgagggcgtccgcgttcacaccctcgatcggcgtgttcaggatggcggtctcggcgacctgaccggccgagcaaccggccagcgcgatggcaccgacggtggcgacacccgcgaccagggcggcgcgacgggttaccagcgagcgcatcacgatcctccaaatagcgacaccaaggtgtgagatcagcctagtgggcggcaaacagccgcgtgcgccgacccatccatccggccgctgtggatcacaccaccggcccgctgaagatcaacaagagaacgtcgatcagggcgaccaccatcaccgcccggaacagagcgaccggccggccacgggcgcgggcggcggcgtaccccccgatcggcaggaccacgacggcggccgcgccggccgcccaccccgaccacgacggcgctccgggcgggcccagcaccagcgtcgcggtagcgcccagcagcaacgccgcggccgccaggcgggaaccgccggcaccgatccggtgcggcagaccgcgcaccccggtcgccgcgtcgtcgtccagatcgggcagcacgttggcgaagtgcgcgccggcgccgagcagcccggccgccgccaccagccagaccggcggcgacggatgcccgggcaggccgaccaccacgaaggcgggcagcagcccgaacgcgatcagatagggcagcaccgagaacgccgtcgatttcaacggccagtcgtagagcaggccgaagaccgcggccaccgcgatcgtcacggtggcggccgcgcccagcggaagcgccgcgaccggcgcggccagggccgccaccagacccgcgacgccgacggtacgccgtgacacggcaccgtccgcgatcggcttgtcccggcgtccggcccgccggtcccggtcggcgtccagccagtcgttgacccagccgaccgcgagctgggtcgccgcgaccgccaggaacacgcagagcagccgcccggcgcggtgcccggcgcccacggccagcagcgtcatggcgacggtgacggccgcgcccggctccgggtgggcggcgcgcagcagggccaatgaccttcggcgatccatgaacggccattgtccaccggcccgggttgtccacaagccgggcccgcccggtggtgggcggggcgcaaccgtgcgagtctcgatcacatggtgtcgatgcggcgcaacgatccgtgccagtacgacgaactggccggcgagtggtggcgtcccggcggcggcttcgagctgctgcactggctggccgccgcccgcgccgagctgatcccgcggccggccgggccgggccgggtgctgctcgacgccggctgcggtggtggcctgctcgcgccgcacgtccgcgacctcggctatcaccacgtcgggatcgacctgcgccgcgccgggctgacccgggccgcccgggagggcgtcgtcccggtcgccggggacgtgaccgcgctgccgctcgccgacggcgcggccgacgtggtggtggccggcgagatcttggagcacgtcaccgacctcggcggcaccgtcgccgagctgtgccgggtgctgcgccccggcggccgggtggtgctcgacacggtcaacgacaccgcgctgagccggttcgtcacggtcaccctcggggagcgggtcggcgtggccccggccgggctgcacgacccggccctgttcgtgtcgccgcaccggctgcgggccgagttcgcccggcacggcgtgcggctggcggtgcgcggcgtccgtcccagcctcaccggcctggcccgctggctgagccgccgcccgccccggcccggccggcccctgggccgcatcctgcccaccttctccccggcgatcctctaccaggccgtcggtcacaaacctctcggacaggcggcggcgtgacagcggtgatcagcgggatgggcgtggcgttgcccccgtccaccgtgcagaacgacctgtgggacggcttcttcgcccagcactacgcgaacgggcggcgcggcctggcccggcgcatcttcgcgaactccggggtggtcacccggcaggccgcggtgagcccgctcaaggaggacgtctccggctggtccaccgagcggcggatgcggcgctaccaggacgaggcggtcccgctgggccgggccgcggcggaacgggccctcgccgacgccgggctcgccgccgccgacgtcggactcttcgcggtctgctcgtgcaccggctacgccacccccgggctggacatcctgctcgcccgggacctcgccatgtcacccggcgtgcagcgcctctttgtcggccacatggggtgttacgccgcgttgccggggctgggcgcggtgagtgaccacgtggtcgcccgcggtcggccggccctgctcctgtgcaccgagctgaccagcctgcacatgcagccggtcggcgccggcgcgcccgacgtccagcagatcgtctcgcacgcgctcttctccgacgcggccgcggccaccgtgctcaccccggcctcggccggcctccccggatacgcggtgcgcgagctcgccgcggtcaccgacagcaccaccaccggacacatgacgtgggaggtgaccgacctcggattccggatggggctgtccccggaagtgcccgcggtgctgtccgtgcacgtgcgggcgatggtggcggagctgctcgggcggcacgggctggagatcgcggatgtggacgggtgggcggtgcacccgggcgggccacggatcctggacgtggtgcaggagcggctcgggctcgacgacggggcgctggaggcgtcgcggggggtgctctcggcgtacgggaactgttcgtcgccgacggtgctgctggtgctgaacgcgctgcgcaaccgggcgagtccgccgcggcgggtggtgatgctcgctttcgggccggggttgacgctctacggggcgttgttggagttgtcgcctcgggggtgagactggtcgggcttcgtcggctccgtcggtggcggctcgttggattgcggcgggctccgccggtggcggctcgttgggctgcggcgggcttcgccggtggcggctcgttgggctgcggcggctccggttgtggcggctgggtgggggagggtcactactgctcggtcgatgaggtcactacagtcggagcgtgagcgaacggggacggggcgccatcctgcatgggctggccgccctggtcctggcggcgggcggcacctggtggtggcgcgccgcaccgcgggacgcctccgatccgcgcctgctcacctggcggctcaccgccgaacagctgctgccggaaaccggggaccaggaggccgccgagaccgtggcgctggctccgcgacaggactacgagaaggtgtccgacctcgacggcggaacgttccaggtctcggtgatctgcgcggggccggacgggagccgggcgcgggtgagcttcgggggaccggagagcgggctcgggctgaactgctccgggacccggacaccgcaggtgttctcggtgggggtcgggaccgagttgcggctgcgggtcaccgccgagggcgaggggccggtcgtcttccgctacacccttcagcgcgcctgatcgccttctcggagactccgaccgggttcgcgcctgcttcgggatcgggttccgcccgggttcgcgcctgcttcgggatcgggttccgcccgggttcgcgcctgcttcgggatcgggttccgcctgttgtgggctgacaaggcgatatgacctcttggcccttttgggcagttggaggtaatcaggtaatgcggtcgtgtgcggctttccgcatcgtccgggcttccgggggcggtcgctcggtgtcagccggtcagagccggccggtcagaggcggccggtcagaggcggccggtcagaggcggccggtcagaggcggccggtcagaggcggccggtcagaggcgctgcagatcgggctggatggactcgacggcgacgacgtgcgggaacttccggaggatggtgcccgtctcgttgaccaggatggcggcggcggtgccgtcctgcccggtgaggcccatctgctcgcggagggcgccggtgggatcctgcaggtagcggaccgccttgccgtcggacggcggggcctgggcggtggtcagtccggtgggggtgggcgccgagggacgcgccgacgacacggcgaggaccgcgatgtcggaccggacggcggcggccgtcgcggcgaccagggcggcgcagtcgcaaccgtctgtgatcagcaccacggccggcagccggccgcgcagcgggaccgtcttgccgtcggcggcgaccagttccagggccggaagcgtgttgctcggggccggcgtcgtgcccgaggtgcgctgcacggacggctggcggaccgggcccggccaggccgaggcgaacaggctggcaacggtcaccaggatggccatcgagacgatcagcaccggggcgcgcagcatcagcgtgccgacccggcgcagccggcgcatcgacgggcggcgtgccaggcgctgccagcgcgtcgccgccgtggtcaggtgcagctcggcgcgcaccgcctcgacctcgtcggacagctcggacagatcgtcggggatgacgatcacgccccactcctcagggaggtcgggcagctcatcgggccaaccgccgtcgggcggccagccaccgttgtcgctcgcgcctgccatgacccacctcccccctggccgaccagatcctgcttcggtcggggaacttccgtccagcgtctcgcacgctacgccgcatcgccagcgaaggggcggcgaggaccgcagcgatacgcttgatctcgcaaagccatcaggtccggaattcccgactcgtcagcaagagcggtcacctcctggtcactttgcgttacttaggcagcttccggccgtgctgtcaagcggtagaaagccccgtcacagggcctctgagctgcactaacagtgaccgtcagggcgagacaccgacgcctgggcgtgttaccctagacacagcgaaaggggtttcgaacctatggttttcagtgtcggcgagaccgttgtttacccccaccacggggccgcactcatcgaggcaatcgagactagggtcatcaagggcgttgaaaggcagtatctcgttctgcgtgtcgcccagggcgatctgacggttcgggtgcccgctgagaacgccgaggaagtcggcgtgcgcgaagtggttggcgaggaaggcctgggcaaggtcttcgacgtcctccgcgctccgcacaccgaggagccgaccaactggtcgcggcgctacaaggccaacctggagaagctcgcttccggtaacccgctcaaggttgccgaggttgttcgtgacctctggcgtcgcgagcgggagcgcggtctctcggcaggcgagaagcgcatgctcgcgaaggcccgcgacatcctggtcggcgaggtggccctcgctgagaagagcaccaaggacgaggctgaggttctgctcgacaaggtcctcaccgaggcctgatccaccgacgcatccctcaccgcaccgtgatcgccgaccgcgacgtgaccgcgcagctcaatgctcgcggtgacgtcgcggtcgtcgttccggcggcgggggcgggtctccggctcggcccgggcggcccgaaagctctgcgtctgctcgacggcgagccgctgctcgtgcacgcggtccggcggttggccgcggccgcgccggtccgcatgatcgtggtggccgctccgcccgccgaggtcgacgcggtgtccgcgctcctcgccccggtggccccggtcaccgtcgtgcccggcggcgccgaacgccaggaatcggtcgccgcggcactcgcggtcgttccgccggacgttccgatcgttctggtccacgacgcggctcgatgcctcaccccgccctcggttacggagcgtgtcgccgccgctgtccgggacggtgccgacgcggtgatcccggtcctgccggtcgtcgacacgatcaaagaggtcgcggccgatgccaccgttctcggcacggtcgaccgttccgtgctgcgtgcggtacagactccgcaaggcttccgcgcctcggtgctgcgcgccgctcaccgggccgccgccgactcacacaccgacgacgccggtgccgtcgagaagctcggcatcccggtcctgtgcgtcccgggctccgacctcgcgctcaagatcacccggccgatcgatctggcgctcgccacgcacctcctggccctgccggacccggacgcccctaccgcctgaccttggccgggtgttccggctggtctgatcgcgggtcggtgacgtctcgccggctgactttggccgggtgttccggctggcctgatcgcgagtcgtcgacgtctcgccgggcgacctcgggccggatactgcgaatcaccccgctgcaacggcgcgccaggccccggtgttccggttggttcgatcgcgggccggtgatgccgtggcccgttccccggtccggctgatcgcatggctcgctctaccggtccggggcatcactgcccggcggcggaacgtgtgatcccgggctcggcgccgcggagcctgaccgcttcggccgacgtggcgcggtggcggcgtcgggttgccgggcgtggtgggggaggtgcgtggttagggtggcgaggtgatcattccgcgggtgggtatcggcacggacgtgcacgcattcgacgctgaccgggcctgctgggtggccgggctggagtggccgggggagccggggctggccgggcactcggacgcggacgtggtggcccacgcggcctgtgacgcgctgctgtcggcggccgggctcggggatctggggggcaacttcgggacgagccggccggagtgggccggggcagccggggtcacgctgctcgccgagacggcgcggctggtccgggcggccgggttcgcgatcggcaacgtgtcggtgcaggtgatcgggaaccggccgaagatcgggaagcggcgggccgaggccgagaaggtgctctccgcggcggtgggggcgccggtcaccgtgtccgggaccacatccgacgggctggggctcaccgggcgtggtgaggggctggccggagtcgcggtggcgatggtctacacggagaacgctcttccggcctgaccggcggggcttccgatcacccggaacgagtgatctccaggtggaacgcctacgctccgactgtgcccgtgcccatggagcctgatcccacgccggaggagcatcgccagcgtgcgctcctgcttgccgacctcgggcgctacgacgaggccgccgacgagatcgcggccggcctcagcgtcgcccccggcggcacggccggtggcgtcggcgatgcggcgagcggtgcggccagcggtgcgcccggtggcgtcgacgacctgccgggcggtgggatcggtggtctcggcgatcaggcgagcggtgcgcccggtggcgccgatgatgcggtgagtggtgcggccggtggtcgtgtcggcggagccgggaaccggtccggggcggccgactccgcaagtggtgcggacaccgcggaactgctggcgacgctcgcccggatccatctggtggcggagcagccggtggaggcgctggccgcggccgatcgggcggcggcggcccgacccgtgtcgctgaccgcccacgtggtgcgggcgatggcactcgccgacaaccggcggtacgccgaggccgcccaggtcgccggggagattctgcgggcgtggccggaggacgcgtacgcgcaacgcaccggagccgcgctgctcagtgagtcgcgtaacggtcaggaggcgctgaacgccgcgtggaacggggtgcgggtggcgccgggcgaggccgaggcgcatctggtgctggcggtggtggcggcccggctgcggctgttcgatctggcgcagcgggcgtacggggaggcgctcgacctggatccggcgatcggggatgccggacaggacgtcgggatcgttcgcctggagcgtcgtcgctgggcccgggcgctggaggagctcgccgaggaggcgtcgctgaccgacgcggacgggtttccggaggagcgggcgccggcacgggccggtgtggtggagccgcccgcggtcagcctgccgcgcagggcggtgctcgacgtgtcggcggactcgatggcggcggtggtcgagacgatccggtacggcgcgaacggcaccctggtggccgccgtggtcaccgcggcgatgacggtggtcagcagcggaatctcgcgggtgtgggcggggctgatcggtttcctggtgttcgtggccgtggtgctctggttccgcagccgcctgaccgagccggccggcccggtgctggcccgcctgcggtcgaccgcccgcccgctggccgccgcgtggcatctcagcctggccgggccgctgttcctgctggcctatgccgtggtcggcgggctgccgacgctgatcgccggcatgctcgtcgccggtatggccgacctcatcgtgctgatccgccgccgctgaccggaagacggccacgcctctgtcgccgccggcctggtgatcatgacgctgcccgggttcgtgaccggtgtcctacggtaccgggcgcacagcgacgaccgggcgatctgaacacctctagcccttctgtcgtccggcacgttaggttcggttcgtgtcgacgatcgtgcctccgctgtatgccgggctcgtcgatgacgcgtctctgctgccgcccagcccgaccggcctggccgacgcggaggcgaagtatcgcgagcacgccaccgcctggtatgcggatctgatcggcaccctgctggtgccggcctccgtggtgggcgccgagccggtgccgcgggtcccggccgcgctggtcggtgacatcccggccggtgcgctgccggccacggtggagaagctgcgcgccgccggcatggtgatcgagcatgtcgaggcggcggtggcgcggcggggcgaggatccgcagccggggttgtcgctgctgcgcacgatcgcggccggcgagctgggggcgaccgggtcggcccgggtctgggcggagatcccgctgagctggggtctgatcggtgctctggacacggtggccgaggcccgccgggagggtctgccgatcgctccgaagttccgggtcggcggcctggccgccgagctgttcccgactccggtggagctggccgcggtcatctgcgcctgccgggaccgcgagctggagttcaagctggcggccggtctgcggcatgccacccggcacaccgacccggagaccgggttcacccatcacgggttcctcaacgtgctggtcgccacgctgctggcggtggacggcggcgaggtggccgaggtggccgaggcgctggccgccacccacccggtgccgctggtggagccggcccgcgcgcaccgggacgatccgcgcccgctgttcgccgggttcggtgcggccagcgtggtggagccgctcaccgaattgatccggctggggctggtcaacggcggctacgagggctgatcgacgggtacgcgtgatcgtgctggacggggcctgaaataattccggccgtgacccgggtgctgctgcgagcttcggtggcggtacttctgctgctggcgacgattctggtgggctggcggattctccggccggccgaggtgctggcgaccgccaagtccccctatccaccgctggtggtgtccgcgccgggggtggtcggccggctcaacgttgcgccgctgctcgtcgaggaccgcctgcgcgtctatgccgccaagcaccagttgcgcgccgacgagccggtcgacagcaagggggtgaacaccgcccactggtcgttgcgccgctggccggcccagctcagcggggtggtcgcggccggcagcacggtggtcagccgctggtcggacggcgcgatcgtggccctcgacgcccgtaccgggaaaatcgcctggcgggccggcggtccgcaggcgccggattatgccgggcaccggaccggcgccgcgaccgtctggagtcctccgggcctgcgggtcgccgccggcgccgtcctggttctgcaggatcagagattgaccgcgtacgacatgggcaccggcgccgtgcgctggcaggtcagcactccggccgcctgcgcggacggtttcaccactgcgggcggcgccttcgtctgcgggtccggcgccttcgacggggccaccggcgccgtgctgccgggctggccggccggcaagttcgcaccggtcggctgcgcggtcgcgagttcgggctgtgccggcttgcgggacggcgcgggccacggctggctcaccggccgggtcgccccggtccggtcggtcgctctggacgacccggatgccacggtcgccggcggcatcgtggtgtcgacggcgaacggcgtggtcaccggtcaccgcccggacggcagcgccgcctggggctggtccggcgccggccgggtgctcggcggcgtcccgggccgcatcctggtcctcaccgacgaccacttcctggtcggcctggactccgcggacggtcgggagcgctaccgcttccacctcgccttccgcaaggagaacgaccagtggagcctcggcggtcagatgatcggcgaccactatctggcgctcgagcggctgaacccgaagccgccggccgatcgggagtcgccgacctactacttcaccaccgacaccgtcctcatggtcgggctgtaggtcacgccagggtcggcagcagggcggtccaggcctcctcggccgccccggcgatcggcccgcggtcgccgaggacggccgccacgatcggtggcggcgactcacggtggatcgacatcagcccgtcccgatacgccgcgccgatctcgtccggcgccaccgccagcaggtcggcgcccagcccgccgagcgtgatgaggtccgcgtccagcccgttgaccagtccggcgatgccccggcccagagtggcggcgacggcccgcaccgcggtgaccgtacgcccgccggcggccgcggcggcgatcacccgccgggcgtaggtgatcgggtcgggtggttccgggtcgcccagcagccgggcgagttcgtgcccgtccaccgcgatgccccagcagccacgcgcgccgcacgggcagcggacagccgggtcgccgaacggcatgtggccgaactcaccggcggccccgtgggcgccgatcaccgggcgaccgccgtccaccacggcgccgccgagtccggattcgatccgcagatgcagggcgaccgacgcgccggccgccgcgccgcggtgcgattcggcggcggccgccagggtggcgtcgttgccggccacgaagacctcgccggccgcgccgagctcggtcaggtcgacgtcgtgccagccggtgccgaccgcttccaggcgcaggtcccgggagacggtgccggggacggagacgcccacggcgcgcggacgatgcccgtacgccgagcgaagctcctgaagcgcgccgcggaccgccgagcggacctcgggccaggcggcgccggcgtgcccgcccgtccggctgccggcgatcgcgccgccgagctcgaccgcctcgacccgccagccctcgtgggtgatcgcgacggcgagggtgagcggcccgtcggggtggggcagcagcagcgtggtggggcgtccacggctgccgctgggtgcggccggggcctgtgtcagcagtgccgcccggctgagtctggcgaccagctcggtggccgcgccggtgccgacgccgagcagccgggcggcgtcggcgcgggtcacgccgggcgtccggtgcaccacccggagcagttcggtggagcgcgtcgtcacatccgttccctttcttatgctcttcggcagagcttattctgtgggggtgagttttcaccgccccgcgctggtcgtcctcggagcttccgcgttcttctacgtcaccgccgaaacccttccggtcgggctgctcccgcagatctcggccggcctgcacgtcaccgaggcccaggtgggcctgctgctgaccagctacgccgtggtcgccgcgctgagcaccatcccgctcaccgcgctcaccatgcggtttccccggcacaccctgatcgccgccacggtagcgatcttcgcggtctcccaggcggccgccacgttcgcgccgaccttcgtggtgctggccgcggcccggctgatctgcgcgctggcgcacggcgtcttctggtcggtgatcggcccgatcatcgcccggctggcgccaccgcaccaggtcggccgggccaccgcgctgaccttcctgggcaactcgctggcgatcgtgctcggcgtgccggccggcaccgcgctcggccagtggctcggctggcgggtcgcggtcgggctgatggcggtcggcggggcggtctgcgtggcgctgctgctcgcggtcctgccgaagctcccgccgatgccccgggacctggccgccggatcgcgggagcagctgcgcaacgcggtccggatcctgcgcaacccccgggtggtgcggctctgcgcggtcaccggggtgctggtgatcgggcatttcgcggcgtacacgtacatcgcgccgctggtccgccgggatgccgggctggacggcgccgggctcagcgccctgctgctcggttacggcgcggtcgggctgctgaccaccttcctggtcgggcggttcgtcgaccggcacccgggcccgctgctgctcggcctgctggccgtgcaggcggtgtcggtggcgctgctcgccccggtccccgggaccgtgcccacgatcgtggcgacgctgctctggggcggcgcgttcaccgccatcccggtgttcctcggagcggcgccgctgcgggtcgcgccgaccgcccgggacgcggcgtccgccgtctacgtggtggccttccagatcggcatcggcggtggcgcgttcgtcggcgaacggttcgtcacggccggccggctcggggcgctgccactgctcgccggggtgctcgcggtcatggccggggtgctggtggcgacgtcccggacggtgttcccggcccggatgtcggcggccgaccacgaccgggtgtccgccgaggctgactcgttcgagggcattgccgcccgcagcggccaccacgagcgcgcggcgtcgtagggtcgacatcggccgcaaggaaaagtctggccggcccgcggcggattcgcggaccggccagacttcctgtcgactgttaccaggtcgcctcggcggcggccaggaatgcgtcgttctcctccggcgtgccgatcgtcacccggaccccgtccggctggaacggccgcacgatcacgccccggctctcgcaggccgcgccgaacgccgccgaccggtcacccagcggcagccagacgaagttcgcctggctgtccggcacgtccacgccgagtttccgcagcgcctcggtgacccgggtgcgttccgcggtgaccagcgcgcaccgccggaccacctcggtctcctgccgcagcgcggcgagcgcggccgcctgcgccaccaggctggtggagaacggggtgagcaccttgcgcaggacggcggccaccgcgggcggggccaccaggtagcccatccgcatgccggccaggccccacgccttgctcatggtgcgcaggaccaccacgttggcccggtcgccgtaggtctccaggccgtccggcaccgccggatcggtgacgagttcccggtacgcctcgtcgagcaccacgagcacgtccgacggcaccgccgcgaggaaccggtccagctccgcccggtgcagcgcggtgccggtcgggttgttggggttgcagacgaagacgagccgggtgcggtcggtgatcgcctcggccatcgcggtcaggtcgtgcccgtggtccggccggttcggcacccgcacgctggtggcgccggccccggccgcgatgatcgggtacgcctcgaacgaccgccaggagtagatcacctcgtcgccgggcaggcaggtcgccttgaccaggatctcggccagggccaccgagccgcagccggtgaccacccgctcggcggccaccccgaaccgctcggccagcgcgtcgcgcagcgccagcacgcccatgtccgggtagcggtgcatctgctgggccgcctcggtgaccgcctccaccacaccgggcagcgggccgtacggcacctcgttgctggccagcttgatcgcctcggcgacgcccagctcgcgggccaggtcggcgacgttgcgaccggggacgtaggcgggcagcgcgtccaggtcggcgcgggtcagccgggtcatcggggtcctccaggaagatcgccgccgggcgtcgcctcgacggtcggttgagcgccgtccgggaccgccacgacgacggtccgggccgccttgtcgtgccaggcctgccgcaggcgcgagtcgaaggtgggggagagcgagtccagcaactgcaccacgaagccgaccaggcaccaccagaacaggctccagaggccgagctgcgcccagcggccgaacgctcggcggaagccgatcggctcggtgctgtccagcccgacgacccggatccccatcatcatcttgcccagggtctgcccgcgtccggcgatcgccggagcctcgtagagcagccagagcagggtggagatcaggatgatggtcatctggagggtggccatccgctcggtgcccaccgggtagtccggcttggcgccggcctgcacctggtccatgtacctggtcaggatcgggtggaagtcccgccaccactggtaggcgaaccatccgttgaccacgatgttgagcaccagcaccacggcgatgtcgatcagccgggcgaccagccgctggcccagcccggccagggccatgccgtgcgggtgggcgaccgggatcggatagaagtacgcgtgcggcggctgggccccggcctgcggatgccaccccggcggcgggggcggtggtgcctggaaatgctgctgctggggccacccgggcggcggggcgggccagccgggcggcggctagctagctagacgggcgggacgggcgcgggttccacctccaccggcggcggcccgtccggcgggaccgcgtcggccgggatggccttgcccagccagccctcaccgtcccagtagcgctgggtgctggtgtcggccgggtccttgtaccaacccgcgggaagggaactcatgcgcaaacctttaccacgtatgcctgacggttccctgcgcgcaggtcagtgcgtcacaggttgccgcgccgctcctgctcccgctcgatggcctcgaagagcgccttgaagttgcccttgccgaagccgagggagccgtgccgctcgatcaactcgaagaatacggtgggccggtcctgcaccggggccgtgaagatctgcagcaggtagccgtcctcgtcccggtcgaccaggatcttccgcttcttcagctcctcgatcggcacccgcacctggccgatccgggcgcgcagctccgggtcgtcgtagtacgagtccggggtgtccaggaactccacgccggcgccgcgcatcgcgtcgaccgtggtcaggatgtcgttcgtggccagcgccacgtgctgggcgccgggcccgtcgtagtactccaggtactcgtcgatctgcgacttgcgctgcgagacggccggctcgttcagcgggaacttgaccttgcggctgccgtccgccacgaccttggacatcagtgccgagtagtcggtggcgatgtcgtcgccgatgaactcggccatgttggtgaagcccatcacccgccggtagaactccacccactcgtccatcttgcccagctccacgttgccgaccacgtggtcgacggcctggaagaagcgcttcggacggaccgcgacgatcggctcgcgggccacgaatccgggcaggaacgggccgtcgtagccggagcggtcgatcagggtgtgcacggtgtcgccgtacgtcgcgatcgccgccatccggaccgtgccgtgctcgtccttcacgtcgtacggctcggtcacgccgcgcgcgccggtcgaggtggcgtgcagataggcggcgtcgacgtcgggcacctgcagggcgatgtcggagatgccgtcaccgtgcttggtgacgtgctcggcgccgggggctccggcgtgcaccatgccggtgaggatgaacttggcgccgccgctgaccagcacgtactcggcgtggtcgcggtagccctgctcggggccgcggtaggcgacgcacttcatgccgaaggcggtggagtagaagtgggcggcctgccgggcgttgccgacgaggaaccgcaggtggtcgacgcctttaacggggaagacgtctttgttttccgggttttccggcagcgaggtcatgtggtgaggttgacgcaggtcacagcactgggcaagagttgcaatttcggctggtcattctgtgcattcggtagggtggttgacggtggcgactgagcaaggtgtccagctcgacgagcttgacgcccggttgatcgaactcctcgccgccgagccgcggatcgggatcctggagctgtcccggcggctcgccgtcgcccggggcaccgtccaggcccggctcgacaagctcaccgtccgcggcgccatcaaaggcttcggccccgaggtgaccccggccgcgatcggcttcggcgtgatgagcttcgtgaccctggagatcagccagcgctacggccacgacgcggtcgccgggcacctggccgagattcccgaggtcctggaggcacacacgatcaccggcagcggcgacatcctgtgccggatcgtggcccgttcgaatgccgacctgcagcgggtgatcgaccagatcgtcggctacgaggggatcagccgggcgcacacgatcatcgcgctggcggagctgatcccgtaccggacggtgccgctgacccgggcggcagctcggacataagcccatgacacgggctttctacgctcaccgggaaagtggatcgaggtgactagggtgcccgcatggcctcgggcacgtggaagggattcacgctggtcgccgccgtgaccgtgacggtgctcgcggccaccggtgtgtggaacccgttccccaggctctgggagtgggtcaacaccagcgggccggtcgcgcccggcacccgctggcagcagcggctgaccggcaccccgcagagcgtcgcggtgatcggcgacgcggtcgtggtcgaataccgcacctcggtcgaggcgtacggcctgaccgcggcggtgaaactctgggagagcgacgccgactgggccgcggtggccggccaggggtcggacgccgtggtggtcactggccggctgctcaccaagggataccaggtgctggacccgcggaccggcaccgtgcgccgggccgacaccacggccggggcggtctggacgtacgacaacgggatcgtcgatctgcactgtgccggcggcaacgactgccggctcaccgcatgggatccgaaatccggtgatcagctctggtcggtggcgaccggcgggatcggcttcgtgctgcacgcggcgaacccggacctgcccgacacgcaccggctcggcaccggcgacgtcgacgatcaggcggccggcccggcgcagatgcccggcctgctcggcctgcccgacggcgatcgggtgcgggtgatcgacaccgcgaacggacgcctggtgcagaccgtccagcccggcccggaccagcggatcgcggtgaccggcgaccgggtgctcacgatcaccggcaccgccagggacgggacctgctactacggcgtggtggccacctcgccgccgggcaaccgggcggtctggcggcgcgacgggctcaacctgcggaccgcgcagagcgactgcaagcaggaccgtgacccggccggcggatacgacgtgctgctcggcgtcgatccgtacggtcgccaggagctgatcaacgcggcggacggccggattctctggtacggcgacaagtccgccgaggtgctcacggtcgacgaccggtacgcggtgatccgcgacggcgacaccctgcgcggctggtcgttcgcccggggcaaggcggtgtggcgtcagggcggccgggccaaggcgggcgccacggtcaccccgaacgcggtgatcgtggtctcctccgggagggtgaccgcgctgaatccggcgaatggtgcggtacgtgccgatgtgcgtaccgatgcgaaggtcttcactgccgcacccggtggtttgatcctggtttccggtcgcgacatggcctatctgccgtacagctgacgcgccgacacacgcgtatgccgggagcgggttcgcatcgcccgcccccgctggcctaggcttgccgctcatgagcagaggcgccgctttcacctactcgccgctcttgccgaccggcgacgacacgaccgagtatcgcctggtcacggacgagggcgtggacgtcgtcgagggaccgggcgggcgccgcttcctgaccgtcgagcccgccgcgctcaccgtgctgaccgccgaggcgatgcacgacatcgcccactacctgcggcccgcccacctggctcagctgcgcgccatcatcgatgatccgaaagcgtcgcccaatgaccggttcgtcgccctggacctgctgcgcaacgcgaacatcgcggccggcggcgtgctgccgatgtgccaggacaccggcaccgcgatcgtgatgggcaagcgcggccggcacgtgctcaccgacgggcgcgacgaggaggccgtcgcgctcggggtgtaccaggcgtacacccggctcaacctgcgctattcccagctcgccccgatcaccatgtgggacgagcggaacaccgggtcgaacctgccggcccagatcgagctgtacgccgaggacccgaacgggcatccggacgcgtacaagttcctgttcatggccaagggcggcggctcggccaacaagtcgtacctgtaccaggagacgaaggcgctgctcaacccgcagcggatgatgcagttcctggacgagaagctgcgtctgatcggcacgtccgcctgcccgccgtaccacctggccgtggtgatcggcggcaccagcgccgagcacgcgctcaagaccgcgaagctggccagcgccaagtacctggacaacctgcccaccgccggcagcatggcggcgcacggcttccgcgatctggagctggaggccgcggtcctcgaactgacccgcgacttcggcatcggcgcgcagttcggcggccgctacttctgccacgacgtgcgcgtcgtccggctgccccggcacggcgcgtcctgcccggtcgcgatcgccgtctcctgctcggccgaccggcaggcggttgccaagatcacgccgtccggggtgtggctggagcggctggaaaccgacccggcgcgcttcctgccggaggtcaccgacgatcacctggagtccgagcaggtcgtcaagatcgacctgaaccggccgatgtccgagattcgcgctgaattgagcaagtacccggtcaagacgcgactgtcgctgaccggctcgctcgtcgtcgcccgcgacatcgcgcacgccaagatcgctgagcggctggacgccggcgagccgatgccgcagtacctgcgtgatcacgcggtctactacgccggcccggctaagactccggagggttacgcctccggctcgttcgggccgaccacggccgggcggatggactcctatgtggagaagttccaggcggccggcgggtcgatggtgatgctcgccaagggcaaccggtcacagcaggtcaccaacgcctgcaagacgtacggcggcttctatctcggctcgatcggcggtccggcggcgcgcctcgcccaggactgcatccggcacgtcgaggttctggaattcccggagctcggcatggaggcggtctggaagatcgaggtggaggacttccccgcgttcatcatcgtcgacgacaagggcaatgacttcttcgaggccgtcacgaagccggttctgagcatcggcaagcggtaggacggcggcgtccgaccgcgatgccgggtggagccggcgggggtcagccgcagaagccggcgaccgggctcatccattcggcgagctggggcttgagggtcttgtcgaggtcggccgtactcttgatcttcttgaggtaggcgtggtccttggcgctggcctcaaacttgcgcgccgactcctcaccggcctctttgagctccgggttctgcgcgccggcggtctccgtgcggatctgctcgccggccgactgcagctcgtcggccgccgccttctccgccttggtggcgttgtcggcctgcttcgcctccttgtaggcgatcattttgccgatcgccgccccgaagtcgtcgagttggccggtgaacaccttgtcgagcttgccgcagacctgcgcggtgtcggccgagtagtccggcgacgcgatggtgaccggcgccgcgggcgtcggcgcgccggcagtggagaccttcgcgtcgtcgctgtcgcaggcggcgccggtcagcagcacgctgccggcgatcacggccaggatggcgggtcgcatgcggtgattcctcttcgtcgggagcggggccgggtgagctccgcccgacggtacgttccgtttcggctcgcgtccaaccgacagtgatcgtcaagacacgaacagcccgtccacggtgaccgtgagcgggctgtccaccccccgagggcggtgtgccgttccaccgcgttctaggggtgatggtggaggcatctgcggtggaacggccccgtcgtcgactctgccgcaccgtgctctcgttccactgtcgatccactctcacccgtggactactctcgatcaccggcacggggaatgaggtggctacggtgcgctaccgcatcttggggccactgtccgtcaccgtcgatgggcagtcggtggctgtcacggccggacgtgatcgggtcgtgctggcgatgctgctcctgcgcccccaccggatcgtcggcgcgggcgagttgatcggggcgctgtgggacggcgacccgccggccaccgcccgcggccagctgcagtcgtgtatctcccggttgcgccgcattctgccacccgacgtgattgtcaccgaccgtgccggctacggcatccgggtcggcccgggcgagctggacgccgaggttttcacccacgcgctggagcaggcccggacgaacgccgatcgcgtcgcgttccgtgcggtcctggccctgcggcggggcccggtctgcgccgagctggacgcgccggcgatccggcaggccgccgcggtgctcgacgagcggtatgcgttggccgtcgaggactgggcggagctggagctggccgccggcaacgagcgggagctggccggtgagctgaccgcctacgtcgagcggttcccgctgcgggagcggttgcgtggccagctgatgctggcgctggcccggtcggggcgccaggcggacgcgctggccgagttccgccgcgcccgggacctgctcgccgacgagctgggcatcgagccgggcgaggagctgcagaagcggcaccgggagatcctccagggagatctcggtgaggtcgtccacgccgaggcggtgcggtgcctgccgcggacggtcggtgacttcaccggccgccgggagcagatcgagcgtctgatgtccgggatcggcgcggcaaccggcggccccgtcgtcgcggtgatcgacggcatggccggcagcggcaagaccaccctggcgctgcatctcgcgtcgctgctcggtgactgctatccggacgcgcatctcttcctggacctgcagggccacagcgaacgtgacccggtcgagccggccgcggcgctgctggttctgctgcgtcagctcggtctggcggccggggagatcccgctggaagccggtcgtcgggtcgacgtgtggcgcaccgagacggcccgccggcgcgtgctggtggtgctggacaacgccgcgagcagtgcccaactggccgacctgttgcccaccgcgccgggcagcctggcgctggtcacgagtcgccggcggctcaccgggctggacggggtgcgggtcgagtcgctgccggtgctcacccaggacgaggcggtgtcgctgctggcgcagatcgccggagcccgggtggacgccgagccggaggccgccgccgaggtggtccgccggtgcgggctgctgccgctggcggtccggctggccggggcgcggctggcgcaccgggcccgctggcgggtcgccgacctgctgcaccggctcggcgaggccgcgctgcccgagctggccgccgaggaccgttcggttgcgggcgcgttgactctcacctaccgccagctgccggagccgttgcaacgggtgttccggctgctcggggtgtatccggggaccgagttcgacgcgctcgcggtggccgcgctgaccgacctggcgcgcgacaccgccgaggacgtgctggacgccctggtggacgtgaacctggtcgaggaaccggatccgggcatcttccggatgcacgacctggtccgcgaattcgccgcgaccctcgccgccgacctgccagccgtcgaccggcaggccgcgctgaccggcgccctcgacttccagatgcacgccgcggcggcggccaccagcgtgaacaagcgggtgatcctgtggcgggacatcggctcgccccacccggcccggcccgatctgaccgttccggatccgatcgcccggctggagtgggagcggccgcagctggccgcccacatcacggccgcgatcgcggcgggccggctggacgatgcctggaagctggcccgggccgcctggcacttcctgtatttccgcggttacatggacgacgtccgggagctgaacacgctggcgctgccggcggccgaggcgtcgggtgaccgggccgcggtcgccaccgtcgccaactatctggcctcggcgtacgcccgtgccgggcaggccggcgaagccgagggatacctgcgcctctgccttcgactgcgcatcgagctcgggcagcacgcggcggccggcacctcgatggcgaacctggccagcgtctatctgcatcagggacggttgaccgaggcggtcggggcggtgcagggcgcgctgcgctactgggtctcctcccgggtgaaggtcaatgtcggctccgagctgggcgtcctgatcgacgctttggatctgctcggacgcgctgccgaggcgttgcaccacacccggatgcggatgttctccgcgatcgaccaacgggccgaggccgagctggccgcctcgctgttgtacctggcccggatccgctaccgggccggctggctgcgtgccgaggcggcgcaccggtatctcgacgcctgcctgcgcctggcggatcggagcggccaccggtcgatcgtcgcggatgcgcacaacgagcgggccgtgctgcaccgggacgccggccgcctggccgacgcggtcgccgagcaccgccgcgccgtcgagatgtcggtacgcatgagcgacgctcgccaccaggccgagttccgcaacgagtgggcggtcaccctgcgccggttcgatgacctggccggcgcccgggagctgcacgagcacgcccgccggatcgcccaggccgccgggaacccgtactcgatcgcccgggcgcacgccggactggccgactgcctggacccggccgatccggccgccgagcggcaccgcgtccaggcccgggagatcttcgaccggatcggcgtcccgcacgtctgaccggtccgggatgtctcgcggatcaccggtgatctctccggcggcgagggaggatggggacgtgacgagcgatcagagtggataccggatcgaacgcgacaccatgggcgaggtgcgggttcccgccgatgccctgtggcgggcgcagacccagcgggcggtggaaaacttcccgatctccgggcgcggcctggagccggcgcacctgcgggccctggcccggatcaagggcgccgcggcccaggtcaacgcgcggctcggcgtgctggacaaggatctggccgaggcgatcgccgcggccgccgcgcacgtggccgatggtggttacgacgaccagttcccgatcgacgtcttccagaccggctccggcacctcgtcgaacatgaacgcgaacgaggtgatcgccaccctggccgcccgggcgctggaccgcccggtgcacccgaacgaccacgtcaacgcgtcccagtcgagcaacgacgtgttcccctcgtcgatccacctggccgccaccgaggcggtcagcgccgacctgatcccggccctggagcacctggccggtgcgctgcgggagcgggccacggcctgggccgaggtggtcaagagcggacgcacccacctgatggacgccaccccggtcaccctgggccaggagttctccggctacgcacgccaggtgctcaacggcgccgagcggctcaccgccaccctgccccggctcggcgagctgccgctgggcggcaccgcggtgggcaccggggtgaacaccccgccgggtttcgccccggcggtgatcgagctgctccgggagcagaccggcctgccgctgagcgaggcccgcgaccacttcgaggcgcagggtgcccgggacgcactggttgagacgtccgggcagctccgggtggtggcggtgagcctttacaagatcgccaacgacatccgctggatgggctccgggccccgggccggcctgcgcgagctgcgcctgcccgacctgcaaccgggctcgtcgatcatgcccggcaaggtgaacccggtggtgcccgaggcggtccgccaggtctgcgcccaggtgatcggcaacgacgcgaccgtcgccttcgccggcacccagggtgacttcgagctgaacgtgatgctcccggtgatggcccgcaacctgctggagtcgatccggctgctggccgccgtggcccggctgttcgccgaccgctgcgtcgcgggcctgacggcgaacgaggaggtggcccggggctacgccgagggttccccgtcgatcgtcaccccgctcaaccgggtgctcggttacgacgaggcggccgcgatcgccaagcaggcgctggccaccggccgcacgatccgcgaggtggtgatcgaacgcggccacgtgagcgcgggcaccctaaccgaggagcagctcgacgaggcactcgatgttctgaagatgacacggccgtgaaatagacacttctcgaccttgcgtctagcgacccttctcgatgggatgcgggggacacaactccaggaggagcgcattccatgagaagacgcctcaccgccggcgccgtcgtcaccgtgacgggcctggcgttcctgaccggtgcgccagggtccgcggtcgcggagccggcggcatcggtcgactatacggtcgtggccgccgacggggtctccgccgcggatgcgacggccgccatccaggcggccggcggcaccgtggtcagcggcaacgatgccgtcggcgtgtacagggtgacctcggccgacacgacgttcgagagccgggcgagcgcctcggcggcgctgatcggcgccaccgtgcgcaaggccatcggatacgcgccgaacggcgtcgagaaggtggaggccggtctcgcggcgcgcggcgggaagggccatggcccggccaaggccgacccgctcgacgacaagctgtggggcctgtcgatgatcaaggccgacaaggctcgccggatcgagaagggggaccggggcgtcaccgtcggtgtcctggacaccggcctggacgcgtcgaaccccgacctggccgagcacttcagcagccggttgtcccgcaacttcgcccccgacctggtcgacatcgacggcgcctgtgaggtgccgagctgcctcgacccggtcggcaccgacgacggcgggcacggcacgcacgtggccggcacgatcggtgccgcgctcaacggtgtcggggtctccggtgtcgcgccggacgtcaccctggtcgagctcaagggtggtcaggactccgggttcttcttcctcgacccggtggtcaacgcgctgacctacgccggcgaccggggcatcgacgtggtgaacatgtcgttctacgtcgacccgtggctctacaactgcaccgccaacccggcggacagccccgccgaccaggccggccagcaggccatcatcaccggcatgcggcgggcgctgaactacgcgcacgcgcatggcgtgaccctgttcggcgcgctcggcaacaaccacgaggacctgggcaagccgcgcaccgacgcgtccagcccggaccacggcggtacgccgtacccccgcccgatcgacaacgcgtcctgctgggacctgccggtcgagggcccgcacgtgatcggggtgtcctcgctcggcccgtccggccgcaagtcggacttctccaactacggcaccgagcagatctcggtggccgcgcccggtggctggtaccgcgacggttacggcaccgacaccttccagaccgtcggcaacgagatcctctccacctacccgctcaaggtgctgcaggagaagggcctggtcgacgcggacggcaacgtcaccgcggcgggtgccggctcggtcgtcaaggactgcgccggcgacggccggtgcgggtactacacgtacctgcagggcacctcgatggccagcccgcacgcggccggggtgggcgccctgatcgtcagccggtacggcctgcccgacctgcggcacggtggcaggttcctgccgccggacctggtcgagcagatcctgtaccgcacggccgcgaagcacgcctgcccggaaccgcgcctgcagagctacgtgcaggagggccggtccaccgagttcgacgcgctgtgcgagggcgggacgaacttcaacggcttctacgggtacgggatcgtcgacgcctacgccgcggtcggcggtcgctgaggacgccgcgggggcttcgccgcaacacccgagaaggacgttgccgggtgagacgaccggggcggtcaatcccgtcgccccggtcggtacccttgcatggtgactcttcgcttgtatgacaccgccactcgatcggtccgggacttcgtcccgatgacgcccggtcaggtggggatctacctgtgtggcgtcaccgtgcaatcttccccacatatcggtcaccttcgctccgcggtcaactacgacgtgctccgtcgctggctgctgcacgaggggctggacgtgacgttcatccgcaacgtcaccgacgtggatgacaagatcctgcagaaatcgctggagcagtcccggccgtactgggcgatcgccttcgagaaccggctcctgctggagcacgactaccgcacgctgaacgtgttgccgcccacctacgagccgctggccaccggtcacatcaccgagatgcacgacctgatcgccgagctgatcgagcgcggccacgcctatgcggcggccgccgccaacggcgacgtctatttcgacgtccggtcctacgagccgtacggcgcgctctccgggcagaaaccggacgacatgcggtcggccgacgacgctcccgagcgggacaagcgcgacccgcgcgacttcgccctgtggaaaggcgtgaaggcggacgagccgcaggacgcgtactggccgtccccgtggggccgcggccggcccggctggcacatcgagtgctccgcgatggcccggcgctacctcggcgacgagttcgacatccacggcggcggcctcgacctgaccttcccgcaccacgagaacgaggtggcccagtcgcaggcggccgggctcggcttcgcccggttctgggtccaccacgccctgctgaacctgggcaagtccaagatgagcaagtcgctgggcaacgtcatcgacctggccgcggtcaccgcggccgggatccgcccggtcgagctgcgctactacctgggcagcccgcactaccgctcgcggatcgactactcggacgaggcactgcgcgaggccgccgtggcgtaccagcggatcgagggtttcgtccaccgggccgccgagatcgtcggcccgggccggcccaaggcggtgccgccggcattcgccgacgcgatgaacgacgacctgaacacctcggccgcgctcgcggtcgtgcacgacacgatccgcgagggcaacaccgcgctggccgccggcgacgagccggtcattcggggcgcgctgaccgcggtccgggccatgctcggcgtgctcggcatcgacccgctcgacaccgcctgggacggcggcgagagcgccaacaacctgaagccggtggtcgacggtctcgtcgcgctggctctggaacagcgggcccaggcccgcgcacggaaggactgggcggccgccgaccaggtgcgggaccagctcaagaacgcgggtattcaggtggaggacactccggccggtccgcgctggacggtaggagagcagcactgatgccgggtaattcacagaacgcgagcaagcgggtcacctcgaagaagggcgccgcggccggctcgggcggaaagaaccgctccagcctcaagggccggggcaagaccctgcccgccgacgagcggccgtggcacaagggttactcgggcaccgagaaactgcccgagaagaccgcccgtaagcaggacaaggagcgccgcgccgcggccgccgagggccgcacgcccaaggtcggccagcctggcaccaaggacaccacctggggtcgcggcggtggccgtgccccgggcatcacccgtgcccaggcgtcccggggcggtggccgggtgaccggtccgcgtggcccgcgggtggccccgggccgccggtccaaccccaccaaggaagggccggagctgctgctcggccgcaatccggtggtcgaggcgctgcgcgcgcaggtgtcggccaccgcgctctacgtggtgcagggcatcgacatcgacgagcgggtggcggagatcgtccgcaccgccggcgaccggggcatcccgatcctggagatcagccgcaacgagctggaccggatgaccggtggcgtgctgcaccagggcatcggcctgcaggtgccgccgttcgcctacgaggacttcgacgacctggtcgcggcgtcgctggagcagaccgcgccgctgctggtcgcgctggacggggtgaccgacccgcgcaacgtgggcgcggtgatccggtcggtggcggcgttcggcgggcacggcgtgttcatgaccgagcgccgcgcggccgggatcaccgccaccgcctggcgcaccagcgccggagcggcggcccgggtgccggtctcccaggtggtcaacctgacccgggcgatcaagtcggcgcagaagcagggcttcaccgcgatcggcctggacgccgacggcgagaccgacctctaccagctggaggcggcgatcggtccgctgatcgtggtggtcggctccgagggccgcggcctgtcccgactggtcggcgagacgtgtgacctgcgggtcagcatcccgatggcctcggatgtcgagtcgctgaacgcgagcgtcgcggccgcggtcaccctggccgaggtcgcccgccgccgcgtacacggctaggtcgccaccggaaacagccaggtcggcacaggagaaagccaggaaagtgccccggtccgcggaccggggcacttctcgttgccgtgatcagctgagcgggccgacgctcttctggctggtccagagggcgctcaggccgccgtccttgagcgcggtggtgccgtcggtgaacagcaccgcgatccggtcaccgtcgagcgccagcttggcgacgttgtcctcctcgttcacccacgccgtgctgacgccgccctccttgacccaggcgatgccgccggtggtgagcgcggcgatccgggtgccgttgaggacgtactgcttgaccccggtcagctcggtgatccaggtggtgccggtgatggcgccctccttgacgtacgcggtgccgtccgtgccgagcaggccgatccgggtggtggtcagcgtgatgtccttgatcccggagcgctgggtggaccagccggtgctgaggccaccctccttgacgtaggcgatgccgttggtgagcaccacgccgatccggttggtggtcagcgcgagctgctggacgccctggtactccatcacccaggcggcgctgaggccaccctccttgacataggcgatgccgttggtgagcaccacgccgatccgggtgccggccagggtcaattgcttgacgttgctctgctccagcacccaaccggtgctgaggccgccctccttgacgtaggcgtcgccgttggtgagcagcacgccgatccggttgccggcgaggacgagctgcttcacgccgccggggtactcgttgacccaggacgtcgcggccggagtgccctccttgacgtacgcgacgctgttgttggtgaggatgccgacccggtcgccggcgagcgccacgttgccccacgacttctggtccttggcccgcgcctcgtcctggcccttgagcaggaaggcctgcagcgcgaccagggtgccggtggtgagcgcctggttcgccgcggcgagcaggttgggcagccagccgtcggtcttggcggcgtcccggatggcggtgacgcgggtcttgtaaccggcgagttccttggcagcggcggcgtcctcgtcccgcttgttggcggccgcgccgccggtgaagatgaagtcggtcagcgcctgcgccagcttgtcgtccggcgtgttgagcgcgacctgggaagccagcgagacctcgtcgcccttggcgttgttgtggatgtggagcacgaactgccggtccggcgcgttcaccagctcgtcggtcaccggcagcagcaacagctgcagcagcgactttttggcggcgacgagctgggcggcccgcagcttcgcggcctgcgcctcgtcgccgtcgacgataatgtcgcgcagatcctgctcggcggcggccgccgccccggtgttcaggaaggcgtcccactcggcctggccggtgccgtcggcgatcgccgcctgggcggcggtccagacgtggctgcccgcggtgacccgctgccacaccgcgaagatgaagtcgcggtcgttcctctcgatcagcgccgtctcggacgggtcgagccccacggtcaccgcgaccgaacggcggcgggccttggcggtctcctcgacgatcttggcgtgcgcgtcgtcgtcggccgccacgaagatgccattgacgatgaagtcgtaggcggcgtgcgggtccgacgacaggtaggtgcgcagcgcctcggccttcacgtacggcccggcctcgtcgcgctggtagagggcgaagacgaaagcctggtcgttcaggacgagcaggtcgatgccggggttgacgccgatggcggcggcggccttgaccttgtcctcgtcggtggcgacgttggtcgggtcggcaaccgtcccggcggcggcggtggtggcggtcccggcggcgtgtgcgggcgcggccaacccggtcgaccagaccgtggtggcggtgagaccggccagcagcagatgcgcggcgcggcgtttattagacacagattcccccatgtgagaagccatccgcacgcacctgttcgccagcgtcgcgacagtgcgtggccagggcggatcctggacgcggccggaccgtctcgatcgtccggccgagtgactggaaacaatgtagagcagtgccgtcccggcgtgggggtgatgtccggcgctgtggttgatccaccgcagccgatgtgacgcgatccacaatcgacgacgtgaaatcttccattccggacaacgggattccgttctgtccccggcgcctgtgaggatgcaggccaaccgaccacgggggaaggtttcagtgacgtttccagtgaaacgcctacgacgacgcctgctcgcaggcgttgccgtgggagtggcgagtgtcctcgtcacaccgcagatcgcggtggcgacgccgtacgtgcgggcgccgctcgcggccgcaccgcaggagttgacggtgcagcaggcgctggagcgtctgctgggcggtcaggagcgggcgtcgtcgcccgcgaacgatccggtcgacgacgccgagctggaccggatgctggtccaggatctggcggactacgacgcggatcccgaggtgcgggcggcggcggccgcggcgctggccaccggcgacgcggcgaagatccgggacttcctggacaacggcctgccggtctatcgcaaggacgccgagcagcataagaaggacgaggcggagcggaaccgggcgcagatcgacgagtggctcgagaccggtggcccgctcgtgcgcaagaacgggcaggccgcgctggactcgggcagcgatgccaagatcgctgacttcgtggccaccgggcacgcggcggccgagctggccgaccagcaggatgtgctgagcgccgcgcagaaggcgcagatgatccaggcccgggtcgagcagatggtcgcgcagggcggctacgaggtgcaggagctcggccaggcggcactggacagcgaagatccggcgatcatcgaggacttctacctcaacggttaccagctggccgcgcagcaggacgcggccgcacaacagcagatcaccgatgccctggccgcccgcgcgaaggcggtcgcggacctgaccgatctggcgcagcgggccgcgcaggccgcggacgcgcagcagaagatcatccaggcgagcgtcaccgcgacgaccgccctgaccgacgtgtccgccacgatgggcctggcgaaccggaacgccaagcaggccgacgcggtctacgccgccgacctgccgctgcgtaccgcgggcaagcccacccacaccgcggacctgaccagcctgcgcaccgtcgcgtgccaggacgcggccaacgccgcgcacagcgccgaccaggccaccgcgcaggccggtgtcgcggccaccgccgcggccacgctggagaagaccggcctgacccacggcatcacctggtccgaggtgacccaggcgcagtcggacgcggcggccgcgggccggttggccgccgagaccgcgtgtcatgcggccgaggcgaccgaggcggccggcaaggccctggacgccgaccacagcgcgaccgtcgacgcgaacaacgcggtgaagtaccggcaggccgcggagcgcgagcaggccgccgcggagaagctggccgacaaggcggagaagctcgccgccgccgcgcaggccgccgccgcggacgccaaggcgcagcggctgcgggccgagagtgacgcggccagcgcgcgacagcatgccgacaatgccgccgcgtactacgaggacgcccggcagaagcgcgcggtcgcccgagcggccgccgcggccgcgatccagcattcgctgaacgcgtacgacgcggcgaagcgggcgatcgaccagcagaacatcgtcgtcgccaagggcgccgtcgccaagcagaagcaggacgaggcgctggccgccggtgcccgcttcaaggacaaggcggatcgcgcgcaggcgctgatcacgaaggcctcgaaggacaacgagaacaccaagtccaaggagttcgaggcgcaggcggccgaggcccgccagctcgccgcggagacggcctgcaagaacccgcagacggccaacggctgtccggggaccgccgacatgcagaagatccgcgccgacgcggctcagatgcggaccgtggcgaaccaggccaagaccgcatcggacgcgtcgaaagcggcttcggacacggcggcgggggagtcgtcggcggccgcggcggactagctagctagcgacccaggccgccaaggaggcgcggggcgccctgaaagccgccgcggacgccgccgacgccgcacaggacgcggccggttgggcggacggcgcggcggacatggcggcgcaggccggcagtgacgccggtgcggcgcagcaggcggcgaacaacgcggccggtttcgcgaagaaggcgaagcaggcctcggacaacgcgagcgcgctgtccaagaagatcaccggggtcagcgacacgatctcgtcgatctccgaagcgatgtggagcgtcgcccagtcgatgggcacgatggcgcacacgctgcaggacatcgcctggcaggcgtacaacgccgagcaggcggcggcagagaagaagctcaacgactggatcgacgacaaggcgaagtggctcaacgaccacatcggcgggtcggacgtcacgaagggcttcatcgacggcgcggccggcatggtcaaggggatcatccagaccagcaactgcgtgaccggcacgttcctgggcaccgacgcggccaccgacgagtacacggtgcccgacgtcagctacctgccgaactcggacaagtcctgcaagatgctggtcaagggcgtcaaggacctgctcagcgacccgaagcagctgctgcattgggacgactggaagaagaactggaagtacgcgctcggcgagaccctgttcgacgcgacgttcttcctggtcaccgacggcaccgggctgatcaccaagatcgccgagagtggcatcgcggcgacggccaagcaggcgatcaaggacatcgccaagctgtcggccaaggacatggcggccggcgtcgtcaagttcggcaccgagaagctggtcaacgcgatcaaggaactcggcgccaccgccaccgcccggatcatcgagctcggcgagtccctcggtgagaagctcaagatcaccttcaacccggacgagctgaaggcgatgtcgaacgccatcggcctcaagggcatcgacgccgtcgagggcgcgcttcgcgacctcaaggactcgccgctcatcaagggcctggaggatttcgccgaggagtgcttcgagggcaagaacagcttcgctcccggcacgctcgtcctgctcgccgacggccgtaccgagccgatctcggagatcggcatcggcgaccgggtgctggccaccgacccgatcaccggggccacccgggccgagccggtgaccgcgctgcaccgcaattacgacaccgcgctcgtcgacctcgccgtcgccgaccgggccgggcaccgcagcgtcgtgcacaccaccgaggagcacccgttctgggacgccaccactcgatcctggaccgacgccgcggccctcaagccgggcgaccggctgcgcgggctcgccggggcgaacgcccgggtcgcgtccgtccgctcattcaccggcggccggatcatgcacaacctcacggtggccgagctgcacacgtactacatcctggtgggcggcgcgccggtgctcgtgcacaactgcgccgacctgatcgccgacgacggcaagttccaaggccaggcgcataccctggacgagcacgtcgaccccgacctggcggcttcccagaagctggccatcgagaagaccgcgaagctcggctacgaggtcaagaacagtgtcttcaccgacctgcagaccgcgcagtcggtcgtcgactatgcgatcgccttcaacaaggaccggatcgggaagtggctcagcaacaaggacgcacctcaggagcttgcctggcaggggaaattcggcgccaagaattcgctgggtgtcgcgacggatgtccggggcctgcagacagcgtgcggaaacggcttcaggatcgtcctcaagaaggcgccggggcataagagcggcttctacgtcttcaccgcgtttccgatctgagggagggatccgccatgccgctgtcaccgttcgaccggggaatcaccgccctggcgggaaccttcttcggtcccgagtggctgcaccacggtgatcggttcgacgtgctgcgcctcgcctacggcgcggaggccgacccgggtgcggtcgcggcgacacggcaggaagccctgctcatgctcgggggcctggccaccacagcggttcaagcgctgtggcaggcgggcacccgggcctgggtcggcatcaagcatgctccggacgccggccaccagtggatgcgcgagatcgtcgccttctgcgacgagtggtccgcgcgtcatcccggcccgtcgtccggcgcagagccggcggacgacggccgggaactgctgacttccgtgctcgccctcatcgccgaggtacggattccggaccgggaggtgaccgacgcgttggcggactgtgcccggaactgcactccagacctcgccctgcgctggctcctccaggttttgagcgtggctgatcacccgctgctcaccgcgtcgcagtacgacgtggtcacccaacttgccgagcacctgaaatacggcgaatacgtgctgcccgaccggggcgtcatcgtcgccgactgaagttttctgtttccatcaacggggagaatctgtgtccaccaaacgtcaggccgcacatctgctgctggccggtctcaccgccaccaccgtctggtccaccgtgctgaccgccccggtgtacgccgccggcagcaccaccgccgccgccgcgagtgtggtggccgatccgacgaacctcgccaccgacgaggacaaggtcaaggccgccggcgccatcggcgtcaaccccgggatcgacatgttcgtcctgaacgaccaggcgttcgtcttcgccatctaccagcgggacgaggccgggccggccgtgaaggccgaggcgctgcgcgtctacctgtcgtccgattcacacgccgcctacgacttcatcgtccgcggcatcttcgtcgcggccggcgacgacgcccaggccaagatcgccgagacggccgcgcgggcccgccggagctcggtggcggtcaccgtcggactggactcgtccgagatcgcgctgatcgagaagaacgaccgcgacttcatcttcgcggtgtggcagcgggtcaccgccggcagccacgtctggaccgcggcccgcgacgcgatcgccgacggcaccggccaggccgagtgggacaccttcctgaacaccggggccgcggccgccgccgacctggacatccgggaggcgatcgcgaaggccgacgccgagcaggccgcgaagctgcgggccaagcagctggccgacgccaagacgtcgctgctgcagctgttgctgctgccggtgaccgacgaggaggtcaacgccccgaaccggcagtacgtgctgttcgtgcacaacaacgccaagggttccgaggtctcgctggcctcccaggtcgccctcaacgcccccgacgaccagctcgacaaggcgctgagcgacttcatcttcaccggtggcgcggccgccaacaagcgggacgaggacgcggccgccgccaaggaactcgccggttacaagacccgcgtcaccgccatccgcgacgccgccaaggccgacgcctggcagccgaacctggccgccgccgccgacgcggcactgaacaccgggaccgtggtgtccctgcagacgttcctgctcaagggccaggacgtggcgcgccagcaggacaacgagtacgcggcgacgttcgtccgggacttcaacggggacggcaagcgcgacatcgccgggatcgacgccaacggcgacctgaaggtgtacgtcggtgacggcgccggcaagctggccgagggcggcgcgatgtggccggtcggcggttcctggaagaatcacaagttcatcacctcggcggacttcaacggcgaccagaagaccgacgtcgtcgccatcgacgcccgcggcgacctgaagctgtacaccggcaacggggccggcaaggtggccgagggcggcgcgatgtggccgaccggcggcgccttcaccaactacaaggcgatcatcgcgggtgacttcaacggcgaccgcaagaccgacatcgccgggatcgacgcggccggcgcgatgcggctgtacctgggtgacggtgccgggaaggtgaccgacggcggcaccatgggcggcagctggggcggcttcaaggccgtcgtcgcgggcgacttcaacggcgaccgcaagaccgacatcgccggcatcgacgcgaacagcgacatgaagctctaccccggtgacggcgctggcaagattaccgcgggcaccgcgatgtgggcgctcggcggcaagtgggccggtttcaaggccatcgtcgcgggcgacttcaacggcgacaagaagaccgacatcgccggcatcgacgcgaacagcgacatgcggctgtacgtcggtgacggcgccggcaagctctccggcggcaccgcgatgtgggccaccggcggcaagtgggccggcttcaagcgcatcggctgacacccacaccacaaccacagccacaaccgcaagccacaaccgcaagccacagcccaccgagacggtcccaccaaccgccccccgcgtaacgcgggggcgcggggggctcggccccccggctggcatgcgagggggcccggtccgcgctttccgcggacacgggcccccgtcaccgagcccccagtcggactcgaaccgacgacctcccgtttacaagacgggtgctctagccaactgagctatagaggcgaccggatcagcataacgtcttgaaatgcgatcaccatcttggcaggtggtaggaaaacaaatacggtggcgaggcagttccttctactcggatcgtccggcacgttcctgccggtggaaaggaagtcgattcaccatggctaccgtcacgtacgagaaggcctcccggatctacccgggttctgagcgccccgcggtcaacgagctgaacctcgagatcggcgacggcgagttcctcgtcctggtcggcccctccggttgtggcaagtccaccagcctgcgcatgctcgccggtctggaggatgtggaccgcggccgcatcctgatcaacgacaaggacgtcacgcacctgccgccgaagtcccgcgacatcgcgatggtgttccagaactacgcgctctacccgcacatgacggtgtacgagaacatggcgttcgccctgaagctgcgcaagaccccgaagtcggagatcgaccgggcggtcaaggaggccgcggccctcctgcagctggaggagtacctgacccgcaagccgaaggcgctctccggtggtcagcgtcagcgtgtcgcgatgggccgcgcgatcgtgcgtcagccgcaggtgttcctcatggacgagccgctgtcgaacctcgacgccaagctccgcgtccagacccgttcgcagatcgcgaccctgcaggcgaagctcggcgtcaccaccgtgtacgtcacccacgaccaggtcgaggccatgaccatggggcaccgggtggcggtcatgctggacggcgtgctgcagcaggtggacaccccgcgggcgctgtacgacacccccggcaacgtcttcgtggccggcttcatgggctccccggcgatgaacatcaagaccgtgccgctgaccgaggcgggcgccagcttcggcgcgctgaccatcccgctgacccgcgagcaggtcgccgcggcgcagagcggcgacggcaaggtgaccgtcggcttccgcccggaggccgccgacatcgtcaccgagcaggtcggcgcgctgccgatcgtcgtcgacctggtcgaggacctgggctcggacgcgaacgtctacggtcacgccgacctggccggcggctcggagcgtttcgtggtccgcaccgagcgtcgcaccatgccgcacatgggcgagacggtctacatcaagccgcagaccaactccctgcacgtgttccacgccggcagcggcgcccgtatctgacgtcaggacgcgagaaggccgcccgcccgggcggcctttttcgtggtgaaacgacgattcagccggcgaagcgggcgatcaggtagtccttgtcgccggcgcaggcgatcaccgatcggttccacgagcaggtggagctgcgcacgtcgcgcagccggccgatcagggccggctggtcgccgaggtgcaccccggtcaggatccggtcgtcgaccgacggcgacagcgtgtcggagaagcgcagcacgttgccggcgtcgaggcggaccgcgtctcccggctcgtcggtccactgcgccttgccgtcggcgccgagcagcgtcgtggatttgccggtggtgaccagcaccgcgtcaccgaccgggacgagggtctcggcctgcggggccggccggcgccaggtctccttgtgggcggtcaggtcgtacgccacggcctcggccttgtcccgctggtagccggcggtttcgacgaagcagatccggtcgtcgccgcacggcgtcaggtcggtgacctcggcgccgttgcgtgcggtgtgcagcacggcgggttcggcggtgtcgaagttcttcaggtcgtacgcgacgagccggtcggtggcggactcttcgacgaacaaccgcccgtggtgcgccaccatcttgtcgctgctgtacgcgacgttgctccgggtcttgcccaccttgccggtggcgaggtcgacgatccgggccgaccggtcgccggccacctgcacgatccggccgtcgccggcgtcgtcggcgaccgggaagccgtcgttggtggccggtccggtcaggccgtccggggtggtgacgtccagcacggtgctgttcgccgagccgtccgggttcgcgtcccgccagcgttccgtgccggtggtcaggtccaggccgatcaggttgccgtcggtccggtcgacgagcagcaggatgccggcccggaacagcatcgtgtcgctgctgccgaacgcgtgttcccagcgtttgtgcccggtgcggccgtcgaggacgacgagccggccggtgctctggctggtgctgtaatccgggtctgcgaccagcgccaccgcgtcgggcagcgcggtcatcgagtgccagctgtgcgcggtgcccgcctcggtgctgcgccacagctccttgcgggtgccggtgtcggcggcgacgactccggcggtgccctgctcgtcgacgctcgcgaagtaggcgcggtcgccgcgcacctgggtggccgcccaggtggaggagatcgcggcgaccggcgggaagtgcgcgacccggtcgagctcgtggtagtccagggcccggaaaccgggccccagcaggatggtcgcggcgatcccgagggccacggcggcggccaccgcggcgccgcccaggacccagaaccctttcttgtacgaggtggtgcccgctcgcggctgatgagcggcgtacgtcgatccgctcgtgcccccggcgggcggaccggccggggagctcggtgcgaccggcggggtgaccgtggtcggcggctcggcgtcgtgccccgcccggaccggcggcgccgcctcggccatctgcgcggcctcggccacgtgcgccgcctgtgccatctgcgcggcttcggccacctgcgccgcctgtgccatctgcgccgcctcggcggggtgggccgcgctgtcggcccacgggtcgaccggggcggtgtagcggatcgacggatcctcggtcgaggcggggcgcggcggcagcgggtcgtccatccgggtgtcggtgcggacgggcggctcgtgcggagcggtcggcggagtcggcgtgggggtggccgcggcggcggtgcccgtggcgtacacaagcggatcgggaagttgatcttgatcttgctcgtggccgtgcgcggcggtgtcctcggagccgtcaccgggagctggcatttcgtgggcctccgccgtcgtggtttcggcccgtcatggtaccgagcggcggcccgcgggccaggcttggccgaacccgtcgcgcgtcgggcatttaaggtggtcgtcatgcggatcgaacgcgtgacggacgccgacgaggtgcggcgcggggccgggctcttcgacgcgccgccgatcgacgaggcgaccgagcggttcctccgggatccgacgcaccatctgctgttcgcctacgacgacgccgggacgccgatcgggatgatctccgcggtggagaccacccatcccgacaaggggaccgagatgctgatctacgagctcgcggtggtgccggtggcccggctgcagggggtcgggacggcgctggtcagggcgctgaccgagatcgcgcgggcgaacgggtgttacgggatgtgggtcgccaccgagacggacaacgcagcggcgcaggcgacctatcgggccgcgggcgcctccgacgagaccacgttcacactgctcagctgggatctgctcaccggctgacggcggtcgtccggctgaccggccagaggtagggcaggtcgtccgggacgtcgccgaagaccggacggtaggtggccgggtccttgcgcagcagcgcggactgatggctgcggtgcagatccggatcgccgagccagggcggcagcccgacgatccgggccagctccggctgggtgcggaccgtgctgatgcccttggcggcgcccaggtcggcgagcagggtgtccgcgcaggtgtcggcatggccggaggcggtccacacctcgcacatcgccaggccgtagcggaccagggcttcctcgtaaccgcgccacatcaggaccgcgggatggtgccgccagccgtagtcgtgccgggtgaggccgcgcagtacctggatcgtctcgacgcgttgcttgccgagccgtttctgatcgaggacccgggcgctcgccaggaagtcagggtagggcagaaaagtctgcatgccggggaaatgccctggtgggagccgctgaaacggctctcaccaggggtgcttcagtccgccgaggggatgtcgatcggctcctggagcagccgcggatcgtccacgttggaggccaggcttccggacgggatcaccgacgggctcatggagggatccacggacgcgctcatggtcggctccgggctggccgacggcgcgaccgaggccgggtgcttcggccggctgctctccgggagcaggtcggccggggcgaccggcgagccgccgagcggcagtccggccaggttggcccggttggtggtgggcaggcgccgcggcaggccgcgcacggacagatcgccgtccaggtcgtcgagcagcgggtactggcgggaggcgctctccacggtgtggctgccgtccggcaggatcccgctgatgatcggcagccggccgccgccgagcagcggcagtcgcaccgcgccggtgttcgtgtcggtgagcggcacgcccttgagcgacccgccgaaccggtcgcccgggtggttgtggatgccgccgccgatcacgtccgcggccggcagcgcgcccccggccttctcctcgggtgaccgtccgatgctgttctgccccggcttgacctggaacagttgctggttgtcctggctcagggtgagcagcggggcgcggcccagcgggtcgctgccgatcgggctggacaggcgcagtccgttggtgcgcgacagcacgtcgtcgaccgggccgccgaccggcgaggcggggtccgcgagggcgggcccggtcgctccgaggatgaataggagtcctccggcgatcgcaccggcataccacaacttacgcactgatcttctccagacgggttgctggaaataacggacgaatggtgtcgagtggggcaacgggcgtccccacgggccggtaacggctgactacgattcgtgaacgtgagtacggagatccaccccgacgccgaaaacctgccccacctggtcgtctgcggcgccgatgcgctggtctggacactcgccgaggaattggcgaattcccgccatcggatcaggctgacggtgatcactccgcaccacatccggtccgacgtccccgacctgaagatcctcaagaaggtgggcgtcgagctgcgccacgccgaccggctggacgagcaggcgttcgaggacgccggcctggccggggcgaccgcgctcgctctggtcatgccggacgacatggtcaatctgcacgccgccctgtgcgcccgcgaggtcgagccccggctgcgggtggtggcccggatgttcaccaccgggctggccggcagcctggcccggatcttcccggacagcgaggtgctctccgacgcggagatggccgccccggccttcgtggcggcggcgctcggcgaggtcgcgccgacccacttcagctacggcgaccggaccctctacgtcgcccagcgcgccgatgtgccggcccgcaacgtggtgctcaccctgcgctccggtgtcctcctgccggccgagccggcgcccggtgcggcgggcccggacgatctggtgctggctcaggcggtcgggttgcccgccggcgacgacgtgacccgccgggtgctggcccgggccggccgtagccgccgtccgctgggcggcctgggccgcgcgctccgcgccgccctcaaccgcaagctcggcatcgccgtcctgatcacgctgggcaccacgatgctggccggtgccgtgctgaacatctgggacggcacccggcacaacctgtggcagtcgatctacgtcaccctgatgaccgcggtcggcgcctccgacgtgcaggacaaacgcaacccggtcgcccaggccgcccagctggtcctgaccatcggcggcctggccctgctcccgctggtcaccgccgccgtggtcgacggcatggtgaacgcccgcctggccctcgcccagggccgcctcaccggcgaactgcgcgaccacgtcgtgctggtcggcctcggcaacgtcggcacccaggtgctgcggcagctgcacgcgctcggcgtccgggtggtggccatcgaccggcatgccgacgcccggggcgtgaagtccgcccagcgccgcggcctcccggtcatcatcggcgacgccgcccgcgaggagaccctgcgatcggtctccatcgagacctgccgcgccctggtcgtcctgtccaccaacgactcggtgaaccttcaggccgccctgcacgcccgggccatccgcgacgacctgcgggtcgtgctgcgcctgttcgacgacgacttcgcccagcgcatcggtgccgccttcgacatcaacacgtcccgcagcgtgtcccgtctgtgcgccccggtcttcgccgccgcactgctggagcacaacgtcagcgtcagcatcccggtcgaccgccaggtgctggtcgtcggcacggtcaccgtccgcgagggctcggacctggacggcgccctgctgacggccgtcgacaagcccggccagacccgggtgatcggcatgtcctcggccggccagggctggatcgactggcgccccgacccccgccgcctgctcgtcaccggggaccggatcctggtcgtcgcccgccagagagccctgcgcgcgctggcccgctaggagaccagctcctccgcctcgacgccgagaaccgcctgctcgtcgggcttgttgacgagaacctcggtcagatacgactgcaccgccgggcccatccccacgtcccggccggcccgctcggagagcaaccacttgtgctggatgatctgggagaagatctcctgcggctccagcttgcgacgcatggtggccgggaccgcacggaccaccggctcgaagacctcggtcagccagcggtgcgcggcctgctgttcgtcggtcagcgcgctctccgcgcggtacgcgtcgaggtcgttgagcaactgccgggcctggttctcctcggcgtccagaccggtcaggcgcatcagccggcgggtgtggtagcccgcgtccaccaccttcggccgcacccggtatccgccgtccacggtggacatggacacctcggcgacgtcgaagcccatctcgttgagccgccggatgcgccgctcgatgtggtgccgggcgtccttcgcgacctcctgctcataggtcacctcgtgccacagccgctcgtaacgggccacgatgtcgtcgaccaccgtctccgggtcgatcgactcgtgcagcagctcggcggcctgcaggtcgagacactcgccgaagatgttgaggcgcaggatctcgatgtcctcgctgcgctggccctcggagagccgggggtacaggttgccggtctcggcgtcgaccagatacgcggcgaaggcgcccgcgtcgcggcggaacagcgtgttggacagcgagcagtcgccccaggagaagccggtcaggtgcatccggacgatcagcgcggccagcgcgtcgagcagccggttcatcgtctccgggcgcagcacccgggagaacagcgcgcggtacggcagagagaactgcaggtgccgggtgaccagcacggtctccagcggctcgccctccggcgtctgccggtcggtggcgatcgcgatcgcctgcacggccgggaagtcgatccgttccagggcgcgcagcaggtcgtactccttctcggcgatccgctcccgggtctccttcatcgcgtagacgacgccgttcagcttgacgaagcggacgacgtgccgggagatgccctgcggcagcgcgaccagatggtcggccggccagtcctccagcggcacgtgccacggcaggtccagcagcgcggggtcgatgagggcggaggtgatgcgcaccggtcaagtgtgcccgttcgctctccgcgtcgtgctcgtacgtggctcgttacacaggtgcgaaaccgccttcgagcaccgggagtggcatgcgacgcaagacagtgttcgtcgtcggagcgtgcgcggccctcgtgctggccggggtggccggcgcggtgacggcgacgcgcggcgacgaccatccggcccgggtgtggcactcggcgcccggggtgccgaaggtgcgggtggccgccgaggcgacgctgcgtgccgtgccgtcaccgacgtcacgcgcggcgaagaaggtcgatgaagcgccggtcgtcaaggcgccggatgacctccgccacgcgccgatcgtcgagtccgcacaggtcccggacgagccgggccggcagcaggtcggcgagctgctcagcgtcggcagactcctcggctatctggccggcccgccccgggagacgttccgctatcccggtgcgtcctacgtcaagctgcacttcgcccggatggccatgctgcccggcgactatgtgaccgtgtcgaacccggccgggaccgagtcgtaccgctaccagcccggcagcaccggccggtgggccatgtcgatcaccggggacaccgcggtggtccaggtgcaccgggcgctcgacccgctcggactgcggtccgccctcgacggcctcggcgtgaccgtcgaccgcgcggcgcgcgggttcagtcgtaccgagcaggcccgtgtccccgaggagaccaccgtgcgcccgggccggaccgggcgcgaggaatccatctgcggcccggacacctccgccgacgcggtctgctaccagtcggccgacccggtcgcctacgtcaagtcgaaggcgatcgcccggctgctgatcaacggcaccgagttgtgcaccggctggcgggtcgggccgaagaaccggatgctcaccaacaaccactgcctgaccacctccgaagaggcctacgacaccgaggtctggttcaactaccagtgcgccaagtgcggtgggtacgacgtgttcaaaccgaccaaggtctggggcgaccgggtcttctccaccgaccacgtgctcgactacacgctgttcagcgtcgacgccttcgagaccatccagcagttcggctatctcaccctcgatccggcccgcccggccaagggcacagagttgtacgtgccgcagcacccggccggcgaacccacccggatcgccggggcgaaaggtgacaaggccggcaactgcgccgtcgaggacgccgactacacggggtacgtcgcgcattccgacgtctcgtacctgtgcgacaccgcgggcggctcgtccggctccccggtgctgtcccgcaagaccaaccgggtggtggcgctgcaccacttcggcggctgccccaactcgggcgtccgtggcgacctgctggccgcgaagttgcgggcgtacctttaacttcaacagatgatccgacgccgcatcctgtcctggtggcccgacctgctgctgctcgcggcgttcgcggccctgaccggggcgctgatcaccggccacctgctcaccctcgatcagcgggtggccgactgggcgttcgaccaccagcccgcggtgccgtactggaccgcccgcgtcttcaactacctgggccagggcggcaaggtgctcaccccggtcgccctgatcctcaccggcctcctggcccatcggacccggtcggtgcgggcactgctcccgttcatcgccgcctacgtcgtgacatatgtgacgatcggtccgatgaagctgtatttcgaccgggctgcaccgagctatcccggcccgttcaagaccgagatgttcaacccggtcgccagcggccaggatgcgcgcagcttcccgtccgggcacgtgggcaactcgctggtctggtacgccgtcttcgccatcctgatcgccgagctgctccgccggaggctgacccggcgggagtcgtttgcgatccgggtgctgccggttgccgcggtgttcgtgaccacggtctacaccggtttccactggctcaccgactcgctcgccggcctgctgctgggcctcgtcctggcgcgcctgatcgagagaattccctgggacgacatcccgctgcccgcagcgggcggctggtcgcggcccgctttccgggattcggccgtacgcggctagccccgcccctcgtccctccttctccacgtcgcgccgtctccgacgcgtccttgtgggatcgcgggcgggtcaggtgcctgcaccgtcggcgaggcggtccagcagggccgggatcctggcgagcagtcgctgctcctccggggtgagccggctggcgatggcggccgccacccagtcgcgacgggccgcccggtcggtgtcgagcacggccgcgccggtctcggtcagggtgatcacgaacccgcgggcgtcggccgggttcggcgcgcgactgacgtagccgagccggtcgagttccgccacggtccggctcatgctctgatgcgtcacccggcggcgcgcggccagctcgccgatggtgtgcggcccctcccggctcagatagcccatggtctccgcgtgtgtccgcggcagcgagtcggcgtgcgcgcgggtggtgcgcaccagccgcccgatcgactggcgcaactgttcggcgatgtcggcgagattcggctcggtaggcatggtgctaatgtacaacagtgttgtacaacagtgttgtacaaaacggagggagttcgacatggaactgaccaaattcggccacgcctgtgtggtcctggagcacgacaaccgtcgcctggtgatcgaccccggcgccctgaccccggaggacgccttcgccggcgctgacgcggtgctggtcacgcacgagcacttcgaccacttcagcgccgagaagctgtccgccgcgctggccgccaacccggccctgcggctctggaccaacaccgcggtcgccgaagccttcgacggcgacccggcgcgggtccacgtggtcggcgagggcgacgctttccaggccaacggcttcgagatccgcgcctacggcgagtggcacgccgagctgcacccggacatcccccgcgtgcccaacatcggcttcctgatcgacgacgccgtcttccatcccggtgacgccctgaccgtgcccgacgtcccggtcaccacgctgctgctgccgatgcacgggccgtggtcccgggtcgccgacctgatcgactgggtccgtgagatcaagcccgcccgggccgtgggcgtccacgacggcgccctcaacccgctcggccaggccatgatcggcaacttcctgggcgaccggagcccggcccccaccggagtgcccttcgtccacctggcgccgggtgccgccctgccgttgggctaggtgcccaggtagcgcaggacggcgaggacgcggcggttgtccgcgtcggccggggggagggccagcttgtcgaagatggcggccacgtgcttctccacggtgccgccggagaccgtgagggcgtcggcgatgcccgcgttggagcggccctccgccatcagcgccagcacgtcacgctcgcgcggcgtcagcgcggccagcccgtcggcccggcgggtggcccgcagcaactggccgacgacctccggatcgagcgcggtgccaccggtggccacccggaccagcgtgccgacgaactcggcgacgtcggccacccgttccttcagcaggtagccggcgcccgtcgcgttgccctccagcagccgggcggtgtaccgggtctcgatgtactgcgacagcaccagcaccccgacctccggatgccggcggcggatctcgagggcggcgcgcaacccctcgtcggtgtacgtcggcggcatccggatgtcggccaccacgatgtcgggccggtgctcggtcaccgcgtcgagcagcgcgtcaccgtcgcccacggccgcacacacccgatgcccgtgatcctcgatcagccgggtgagcccggcccggaacagcaccgcatcctcagcgatcaccacccgcacgctcccgccggcccccgggctgaggtcacggtcgcccgcccccacggccggcgcggcatggcggctatcaccgcccagggtgggtgtgggacggcggtcgtcggcgtccagggcgggtgtgggacggcggtcgtcggcgtccagggcgggtgcggcgcggctggcgtcggcgcccagggcgggtggggtccggtggccggtcatgcgtgcagggggagttcgacggtgacctccgtggggccgccgggcgggctggcgatggtgagccggccgtcgaccacggcgacccgctgcgcgaggctagctagctagcggccggcggcccggacggcgagccggttggcgctgctgtgcttggcggcgttggcgaggagttcggcggcgcagaaatacgcgatcgactcgatggccggggtgggccggaccgggatgtcgacgttcaggtcgatcggcatggcgcggtccgcggcgagcgaggcgagcgcgtcggccagcccgttgtcgagcaccggcgggtggatgccgcggatcaggccgcgcaggtcggccagggcttcccgggtgccgcggagcgcggcgtcgagcagctcgcgggcggcttgcgggtcgggcaccgggccggtggcgccgagcttctcccgggccatgccgaggttcatggcgagggtggccagccggatctgggcgccgtcgtgcaggtcgcgttcgacccggcggagcagcgcggccgcgtcgtcgaccgccagcgcccggctcacctccaggtcgtggacccgctgggcgagccgccccggcccgagcaggcggccgatcaggtgcgcgtcggcggtgaccgcggcccgggtgacccagggcgcggccagcagcatcgcggcgccggccgcggccgcggcgaacgtgccgggcagggtcgcgacccggaacgtgccctgcccgaacagaccgaacggcgtgtacaccggcagcgggctgaggtgcacccccggcgcgtggttgcggaacgcgccccaccacagtggatatcccaggttgaccagcccgcccacccagaagaacacggcatagccctggagcagcgcgaccggcagcttgatcatctggtaggcgatgacccgccagccgctcgcaccgtctggcggggtcgcgacccgcaccccgagccagcgggccgcgagccgccggtgcagcccgcccagccgggccgccgccccggtccgcaccaccagcccgatcaggaccgccaggctgaccgccgcggccacgatctcggccggcgacgggttgcgccgaccgtcgtcgacgacccaccagagcagatcgacgagggccacgaacagcaccggcgggctgatcagcgcgaacggcagcccggacaggcagaacatcagctcgcggcccgggcgccggtgcgacgtcgtcggggacgggtccatgccgccatccttcccttacgcgtcgcgccgggccagcagccatccgccgatggtcagcgcgaccgcggcgtacagcgacatcatcccgatcccggcccacgccgacaggaagtgcgggcacgcctcgccgccgcagttcaccggccgggtggtgctcagtgagttctccaggatcagcagcggcatgtacgccgcgaccgcgtgcgccatgatcccgaggaactgggccaccacgtacactccggcgaccagcaccccgatcgcggccgggctgtgccggacgatcgcgcccaggcccaggccgagcagcccgatcaggctgaaggcggccccggacagcaccacggcgcgcagcacgcccggatcgccgagtgtgggcgccgggacgccggcgcgcagggtggcccgcaccgcgacataggcgaggaacgccgcgatctccccggtgagcagcgtgaccgccccgaacaccgcggctttggcggccagcatcagcgggcgccgcgggacggcggccagcgtggcccggatggtgcccgaggagtactccccggtcgcggtgagcaccccgagcacgccggtgagcagcaggccggggacgacgccggcgagcgcgttgttgaccacgtcgccggagccgtcgcgggtgttgtggcccaccgccagtccgatcccgacggtggcggcgatcgtgacggcgagggtccaccaggtcgagcgcagggtgcgcagtttgatccattccatgcgggcggcctggaccggcccgtatccgcgcgtggtcacgacgttgctccccgatactcgacggatccgctggtgagctggaagaacgcgtcctccagggaggcggcctcggcggacatcgcggcgaccgtggtgtcggcgagcaggcggccccggccgatcaccacgagccgctcggcggtcagcgccatctcgctgatcaggtggctggagacgaacaccgtgcggccctgcgcggccagcgagcgcagcagggtgcggatccagcggacaccctccggatcgagaccgttgaccggctcgtcgagcaacagcacgcccgggtcgccgagcagcgcggcggcgacgcccagccgctggcccatgccgagcgagaacttcccggcccgtcgcccggccgcaccggtcaggccgaccatgtcgagcacctcgtcgacccgggaccggggcacggcgttgctcgcggccagtgcggccaggtgcccgcgggcggtgcggcccgggtggaacgccttggcctccagcatcgcgccgacctcgcgcagcggccagcgcagctcgcgatagcgccgcccgccgatggtggcctggccggcatcgggccggtccagcccgaggatcatccgcatcgtggtggacttgcccgacccgttcgggccgaggaagccggtgacggcgccgggccgcacgtcgaagctgagggcgtcgacggcgaccgtccgtccatatcgtctggtgagttcgcgtgcctcgatcaccctggcaacgctattcagccgaggccccggagagcacccggctgacctccgtcttctactgggggaaaacccccaccccggcccgcagcacccgtcgcggcgcgagatcggcgtccagcaccacgacgtcggcgcgcaggccgacggccagcgccccccgatccgcgagccccagcagccgagccggggtggtcgacgacatcgccaccgcggtctccagcggcaacccggcggccaccgcgttgcgcaccgccacgtccatggtcagcgtgctccccgcgatcgccccgtcccgggccagtcgcgccacccggtcggccaccacgaccgcctgcccgccgaggtcgtattccccgtccggcatcccggtcgccgccatcgcgtcggtgaccagaatggaccggcccggcgcgctggtcgcggcgaacgccagcatccccgggtgcagatggatgccgtccccgatgagctccaccgtcgcggtggagctgagcagccccaccaccggcccgggctcacggtggtgcaccggccgcatcccgttgaacaggtgggtggccacggaggcacccgccgccacaccggccagggtctgttcgtacgacgcgtcggtgtgcccgatcgccgcgagcacgccggcttcgcgcagacacgcgatcgccgcgagcgctccgtccagctcgggggccacggtcatcatccgtacgccgcccgcaccgatggtgaccagttcttcgatctcggccaggaccgggtcgcgcaggaacgccgggttctgcgccccgcaccgcgccgacgacaggtacgggccctcgaagtggatcccggcgatcaccccgtcgtcgaccagcggccggtaggcgagtgtcgcctcccgcatcagctcgaacggcgagctgaccaggctggccagcatggtcgtggtgccgtgcccgaggtggaacgcggccgccgcgcgggccgccgccgggtcgccggtggtgaacgtgtgcccgcccccgccgtggcagtgcaggtcgatgaagccgggcacgatcacgtcgtcgccggcggtgtcgtcggcgacgatcgcggcgatcgtggcgtcctcgatgtcgaggtgcccggtgacgacgccgccgggggtgacgatccggccggagatgcgggtcattgcggggtccccagggagtcgagggcgagcagggcggcgcccaggcagccggcggtgtcgccgagctcggcccggacgatctcgggggtgcggtggaaggtgacccgccgggcgaacgcttcgcggaccggcaccagcaggtcgtcgcgcgcctcggccaggccgccgccgagcaccaccacgctcacgtcgtagagcgcctgcgccgcgagcagcccgtcggcgagcgcctcgacggcgtcctgccacacccggccggccagttcctcgccggccgcggcccgggtggccacgtcgaaggcggtggccccggcctgcccggacagttcggcgtagcggcggccgacggcccgggccgacgcctccgcctccaggcagccgcgcaggccgcagccgcacgggacgccgccggggcggaccgtcacgtgcccgatctcgccggccgccccgtgcgcgccggagtagccggtgccgttcaccaccaggccgccggcgatgccggtgccgatcgcgacgaacagcacgtgccggcgtccgcgcccggcgcccaggcgggcctcggcgagggcaccgacacgcacgtcgtgaccgagggccgcgggcagcccgaggcgccgctcggcaagatctttcagcggtacgtcacggaacccgatgttcgccgaccagaccgcgaccccggtggtctcgtcgaccaccccgggcaccgcgatgccggccgcgatcggggtgagcccatcggcgcgggccttgccggccagcccctcggcgacgcccaggatgtcctcggtgaccgcttgcggcccccggccggccagggtcgggtgccgttcctcgtggtgcaccaccccgcccgggcggaccagcgcgcacttcatcccggtgcccccgacgtcgagggcgatgacgacactgtccggcacggcgaagcgggtcacagcgagtcgggcagcacgatggaccgggtcaggccgctcgggttgtccgggtcgaggccctgggtggtggccagcagcacggccacccgctgggcgaggaccaggtcggccatcgggtcgagcggggcgcgcccgccgacccagcggcccagcgacgcgtatccgccgtggtggcggctgtgcacgaaggcggcgccgcgggcctcgacctcgtcggccaggccgggcgggacgtcgccgaaggcccacaccacgcggcgcgggccggcgatcgagatcgggccgtgccggtagtccatggccgggtaggactcggtccagaagccggcggtctcccggcacttgagcgcggcctcctcggccaggcccacggtccagccccgaccgaggaaggtgatctggtcggtgagcgccgggtggaccggcagcggcaggcgcacggccacctccgcgtccatcgcggcggcgtcgatgtcgtggcccaggtgggcccggagcagggccagcacgctggtggcgaagcgggtctgcacgaccgacttctcgtcggcgaagtccagcaccacggcgttgccggcgatgtcgacggcgggctgggccgggtcggcggtgagcacggtgaccggcgtgctctcgccgaccgcgcgcatcacctcgagggtctcggtggtggtgccggaacgggtgatcgcgatgagccggtcgtagcgccgcccgtacgggaagtcggaggcctggaaggcgtcggtctcgccgtgcccggcctgttcccgcagcaccgcgtacgacttggccatgaaccaggaggtgccgcagccgaccacggcgacccgctcgccgcgggccggcagtccgggtgcgtcggccagcttggcggcctgccgccagcagtccggttggctggcgatctccgccttaacgtgcgtcatggctcatcctcaccgattgtgctgcgcattcgcgctcggtagccgggtatttcgcgcgttattgtgctcatggcgctggcgcgggggcaagtaccgcgcacttggactctttgcttctcggcctttcgcgcactaatgtgcacacacttatcatggatcgtgcatcggggagtgacgggtggaccggtacgcgcgctggaatgccctgctggagctcctcacggacagcggccgggtgtccgtcgaggaggccgctgagcggctggacgtctcgcaggcgacgatccggcgtgacttcgatcagctggcccagcagcagatgatcacccggacccggggtggcgcggtcgccaacggggtctcctatgacctgccgctgcgctacaagagcgccaagcactcggccgagaagcagcggatcggcgaggccgcggcccgcctggtcaccccgggcaccgtggtcggcctcaacggcggcaccacgatcaccgaggtggcccgggcactggcggtgcgccccgacctgaacgccggcggcgagggctcccagctgaccgtcgtgaccaacgccctgaacatcgccaacgagctgctggtccgctcccggatgaagatcgtggtggccggcggggtggtccgcccgcagtccttcgaggtggtcggcccgctcggcggggcgctgctcaaggaggtcaccctggacatcgcgctgctcggggtcgacgccctggacgtggaactcggcgcggcctcccaccacgagggcgaggcggcgatgaacagcctgatggtggcccgggccaagcgggtcgtggtgatcgccgactcgtcgaagctgggcagccacgcgttcgcccggatctgcccgatcacccagatcgagacgctggtcacggactcgggcgcgtcgtccgcgacggtcgccgccttccgggacgccggcgtggacgtgatcgtcgcctgatccgtgggtgtcccgacgattgagacgggagaacgagcgtcgatcctttagggtgcggcgatgaccgccgtactcgagatatcaggactgcgcaagacctatcgcagtcgcaagggtgtccggaaggcgctggacggcttcgacatggtggtggaggccggccaggtgcacggcttcctcggcccgaacggatcgggcaagaccaccacgttgcgtacgctgctcggcctgatcaagcccaatgacggccggatggcgatcctcggccaggaggtcccccgacacctgccgcaggtcgccggttcggtcggggcgatcgtggagagcccccagttcttcggcaacttcaccgcggagaccacgctgtcgctgctcgccgacgcgggcggggtggcgcaggcgcgggtgccggcggtgctggagctggtcggcctgcgggaccgggcccgggagcgggtgaaaacctactcactcggcatgaagcagcggctcgcggtggcgtccgccctgctcaaggagcccaaactgctgatcctggacgagccggcgaacggcctcgacccgggcggcatccgggagatgcgcacgctgatgcgcgacctgtccgattccgggatgaccgtgctgctgtccagccacatcctgggggagatccagctgatctgcgactcggtgacgatcatctcggccgggcgccgggtcgccaccggatcggtcggcgaggtgctcgcgaagcactcctcgaccggcgtgcgggtgcgcctggagccgggtgtcgacctggcgggcgccgcggcgatcctccgggcggccggcgcggcgctcaccgtggaacgcgaccacctggtggtcgggaacgccggcaacccggctcagatcaccaagttgctggccgaaaagcagatctacgtgtccgagctcagcccgatcgaggccgggctggaggacgtgttcctggaactgaccggcaccgcgccggtcgacggggcgaaccggcaggtcgatcaggtcacggcgacgcagggtgggtggggtcagtgagcctgttccgggcggagcggcgccggctgaccaagcggcggttcaccaggcttttcgtggccctcgggctgctggtgctggtcctggtggcggccggtgtggcggcgaccaaccagaaggccaccccggccacggtggcggccgcgcaggccgaggcggagaccgggtaccggcaggcggtgcagcagttcgccgaggacaagaagcactgccagcaggatccttcgcagttcggcgggaactgcgacaacctcggtgagccgcaacgggaggactacaaggcggagtactacatgccgtcgacgttcgacttccacgagcagttcccgaacatggtgatcaccttcgcggcgctgatggcgctggtcgcgttcgtcgtcggggcgtccttcgtcggcgccgagtggaacagcggcgggatgatgaacctgctgctctggcggccgcagcggctccgggtgctgtccaccaagctggccgccctgctggtctggctgaccggcctgaccgtggtgaccggcgcggcctggaccgggatctgctggctgatcgcgacccagcgcggcatcaccgcgcggatgaccccgggcgtctggcagtcgttcgggctgatgggcctgcgcggtctcgggctggtggtggtggccggcgcgctcggcttcggcgcggcgtcgatcggccggcacaccgcggcggcgctgggcgcggcgatcggcacgctggtggtgctgcagtacggcctggcgatcgtgctgtcactggccaaggcgcggttctacgagctctatctgctgccgacgtggatctccgcgtggatgaaccagtcgtacaaagtggtcgacgacaacgcgccgtgcgtgctggccggcgggtgtgagccgcccagctacacggtcacctggcagatggcgggcgggctgttcgccgcggtggccatcatcattgtgggtgccgcaatgtggacgatgcgtaagcgcgacatcacctgaggtagcgtacgcggggatcgtcggccgccactatgctgatgatccccgcgcgaaccatccatccatccgtgccgtgagggagtgccatgcagcccgccgccgaacccaccggtgatcagcagcacatccccgcgccccgcaccgccgagccgtccgggcagccggaagtcgccgagcaaccggctctcagcgagcgtgaggagcagatcctcgcgttcgaggccaagtggtggaaacacgccggcgccaaggagcaggccatccgggacaccttcgacctctcctcgacccggtattaccagctcctcaatggtctgctggacaacccggccgcgctggaacgcgacccggtgctgatcggccgcctgcggcggctgcgatcgacccgggcccgcacccgccgccgctagcctcaggcgttccgcttttcggcgtacgactccagccaggcgacctgggcggcgtcgagcgaggcccgcacccgttcgcgcgcggtgctcacgttcgcggcggtgacggtggacgcctccagcgacccgcgcatcgcggccagcgccgcctcccggatcagcgccgagcagtcggccgccgagaaacccgtcagctcctcgccgagggcggtcaggtcgaccgactcgtccagcggcaccgacttggcggaggcccgcaggatcgcggcccgcgccggcccgtccggcggcggcacgtagaccaggcgctccagccgcccggggcgcagcagcgccgggtcgatcaggtcgggccggttggtcgccccgatcaccaccacgttgcgcaggtcctccaccccgtccagctcggtgagcagggcggccaccacgcggtcggtgaccccgccgtccgagccctggccgcgggccggggccagggcgtccacctcgtccaggaagaccagggtcggcgcggcctcccgggcccggcggaacagctcgcggaccgctttctcgctgtcacccacccacttgctgagcagctcggcgcccttgaccgagagcacgttcgccttgccggtcccggcgatcgccttcaccaggtacgtcttgccgcacccgggcgggccgtagagcagcacgccgcgcggcggggtcacgccgagccgggcgaacgtgtccggataggtcagcggccacagcaccgactcggtcagcacctgcttgacctcggccatgtcgcccacgtcgtccagcgtgacggtggccacctccagggtcgactcggccatcgaggtgggccggaccacgtccagcgccgcctcgaagtcggccatcgtgacgctcggctcgtcggacgtcttctgccgcaacgcggcccgcaccccggcctcgcggaccagcgcgcccaggtcggccgcgacgtacccgggggtgcggccggccacgtcgtcgaggcgcacgtcggcggcgagcggcatgccccgggtcagcacggtgagctgctcgcggcgcatcgcggcgtccggcagcggcacggtgagctgcacggcgagcaggtcgggggcgcgcagctccgggtcgaccgactcgggtctgccggtggtgcagaccaccgccgcgccgccggccaccagttcggccagcacctggcggaacaccgtggcgatcgggcccggctcgtcgcgcggcgcgagcgcctccacgtccgagacgagcagcaccgcgggcttgtcgccgcggatcgcggcggccgcctcgcgcagccggcgggcggccgcgtcgttggtgagcgcggccagctccggcgcccagatcagccgcacctcggcgccgaccgtggcggccaccgcccggaccatgccgcccttgcccgacccggacggcccggagaccaggatgccgagcgccacccgggtgtgcagcttggccagcacctcccgatggttgaagccgaggtcgagcagctcctgcagctccttggcctgggcgcgcagcccgaccaggtcctccaggctgggcggcggcacctcggccggggtgccggcggccggtgtctccggcgcggcttcccgggccgtggcggtggccgggccgtcctgccagccgaccaccgtcttcgtggtgaccagcacgccgtcgtcgaccgactcgacggtcagcagctggttggtccaccacgggaaccgcgagctcagactggaccgggtcgacgggctgaccggcggcttgcggtccgggaagacctcctgggacagcagcgacacgtcgtcgcccggactgaccgtcttgccgaacagcgcctggcgcagcatctccggcgggatcgtgccgtgcacgccgggcggcccgctgaggatcacccggctcgccgcggtcagcgggatcggggtgaccgtgaccggcccgccgtccggcaccccggcgttgccgaaggtgaggtcgtcggcgtgcagttgcttctgcccggtggtctcgtcggcgatcacccgcaccaccgtgctgcgcgacccggacagccgcgccgcctggcccggttccagttcgagcgccttcatcgcggtgggatgcatccggaccagggcgcgtcggccctcgtcggccggtgaccgccacgtcatggtcagggtgagatcgtcagccaccgcgcatgcctccgagtgatcgccgggagccttaggtggtccacgctatctgccgccgtcccgcttcacagcccgtgctcaggcgggccgggctaggttgggcgccatgtctgcgttaccccgggtgacccggcgccgggcggtcaccgccgcggtggtgctcgtgctcctcgccgccgcgaccgtctgggccgtgctgcccgcgcgggccgcctggacagcccaggatctgcggatcccggtccgcaccggcccggccggtgaccagcaggtcgagctcgacgcccgcttcctgctgccccgcgaccggtccggcacggtgcccgcggtgctgctggcgcacggcttcggcggcagtagggactcggtccgctcggacgccgagtcgctggccgcccgcggctacgcggtgctcacctggaccgcgcagggcttcggccgcagcaccggcgagatccacctggacagcccggactacgaggtcaaggacgcccggcagctgctcgactggctggccgcccgccccgaggtgcgcaccgacgcgcccggcgacccgcgggtcggcgtggtcggcggctcctacggcggcgcgctggccctgctgctggccgggcaggacccgcgggtcgacgcgatcgtcccgtcgatcacctggaacgatctggaccacgccttcctgccgcagtccgcggcgaccgacgccaccggggtgttcaagaagggctgggccggggtcttcttcggctccagcgcgggcggcgacaacccggcgtgcggccggttcgccgccgacgtctgcgcggcctacctgtcgatggcgaccagcggcaccccggacgcggcggccctggccctgctgcgccggtccagcccggccaccgtgctcgacaggatcaaggcgcccacgctgctcatccagggcgcggtcgacacgctcttcccgctctccgaggcggacgccaacgcgaaggggatcgccgccaccggcacgccggtccgggtggcctggttcaccggcggtcacgacggcggtgccgggcccaggtccgaccaggaccgggtcgaatacctgaccggccagtggctcgaccactacctcaagggccggggcgccgcccccggtgacgacttcaccttctcccgggtggccggtttcagcgcgatggaccgggacctggtcaccaacggctactccaccgactcgtatccggggacgaccggcaccggcagcacccgggtcgcggtgaccggtgcggcgcagccgatcgccaacccgccgaacggcaacccggccgcgctctccgccctgccggggctgggcagccggctcagctcgctgctcagcggcaacctctccgccgacatcccgggccagcacgccaccttcgccagcgcgccgctgaccgccgcggtcgacgtggccggtgcgccgacgatccggctgcgggccgcgtcgccgaccgggtcggcgacgctgttcgtcaagctctacgacgtcgaccagagcggcgcgccgacgctcagcgccgggctggtcgccccggtccggctcaccgggctgccgaccggcatcgagcaggcgcagccggtcacagtcaccctgccggcgatcgtccggcggatggaggccgggcacacgctgcaggtcgtcgtcgccacctcggaccaggcgttcctctcaccgcccgggccggccacctacacggtcgcggtcgacgggcagctgacgctgcccaccctggtgggcacgccgatcgcaacgccggcggcgctgtggtggtacgcgctggcagccctgatcgcggtcatcctgatcgccctggctgtcctgtcggtgatccgccgcgcccgccggcgtcgccgggtgactgccgtgcgcgacgacctcgccgacaccccgctggtggtgaccgggctgcgcaaggcgtacaaggacggcttcgtcgcggtcgaggagatcggcttcaccgtcgagcgcggccaggtggtcggcctgctcgggccgaacggggccggcaagaccaccacactgcgggtgctgatgggcttgaccacgccgaccgccggtgaaatccacgtcttcgggcaccgcctggtccccggcgcgcaggtcctgtcccgggtcggcgcgctggtcgagggccccggctttcttccgcacctgaccggcgagcagaacctgcgggcctactggcaggccaccggtcggccatgggccgatgcgcggttcgaggaggcgctggagatcgccggtctcggtgcctcgatccaccggcggaccaagaactacagccacggcatgcggcagcggctggccatcgcgcaggcgatgctggggctgcccgagctgctggtgctcgacgagccgacggacgggctggacccgccgcagatcgccgagatgcgccgcgtgttgcaacgctacgccaccgacgggcgggccgtgctggtctccagccacctgctcgccgaggtggagcagacctgcacccacgcggtggtggtgaacaaggggcggatcgtggcgtccggcccggtcggcgacatcgtcggcgagtcgccgtcggtcgctttcgaggtgtccgacgtgccggccgccaccgcgatcctctccggtctgggcgtgcgttcggtcaccccggacggcgccaccgggctgatcgtcgagatgaacggcacgccgcgcgccgacctggtcgcctcgctggtcaaagccggtgtcggcgtcgaccgggtggtgccgcgccgccgcctggaggacgcgttcctggccctggtcggcgacaactcgcgggggagtggagaccgatgagcatcgatgtcagtccggatgccgcggcgggttaccgcccgtcgcgcaccctgccgatcgtcgccgagatccgccggcaggcgtcccggcgacgcacccagctggccctcggcttcatggtgctgctaccgctgatcatcctggtcgccttcgagttcggcagcgacaaccgcggcgacgacgacaacggcggtggtgcgttcagcagcctggtcgacctggccacctcgggcgggctcaacttcgccctgttctgcctggcggtctcggccggcttcctgctggtggtggtcttcgccctgttcgccggcgacacggtggccagcgaggcgagctggggcagcctgcgctatctgctggcgatcccggtgccgcgggcccggctgctcgcggtcaagctggtggtcgcgctcggctacgccttcctcgcgctgttcctgctggccggcaccggcctgctggtcggcacgctgcgctacggctggcatccgctgggcagcaccatcgccgcccggatcccacccgggcagggcgtgctgcggctgctcgccatcctcgcctacctcgcggtgatcctgctggtggtagccggcctggccttcctgctctcggtgctgaccgacgcggcgctgggcgcggtcggcggcgcggtcctgctctggatcctgtccagcatcctggaccagatcaccgccctcggctcgatccgcaccggtctgcccacccactacagcgacgcctggttgggtctgctgtccaccccggtgcagaccgaggatctggccaagggggcgatctccgcgatcatctacgcgacgctcttctggggcacggcgttcctgcgcttcactcggaaggacgtaaccagctaggtccacggatcgtagggtgcggcgatctgttctggccgcgccagcggccaagatcgtcgtgcccgggagcggcgggagcggcggtcagtcatcggccgcagcgcacgccatgaagatcttcaaaggtcttcttaccgtgcgccgatcaggaggtcgctcacacctcgggaactcgctggggttattcgtgcatctcgtcgtaagctcggggaaacaactgaatacctcatccagaggggcagagggaacggcccgatgaagccccggcaaccaccgctttcgtgatgcggcaggtgctaattccgtcctccgcggcaggtcgccgccggggaaagatgagaggaacgcctcgatgacgtctaccgtcagtgcacccgctgccatctccacctcgcccgcccgcggcctcgtctgccgtgcctgcggcgcgcagtacccgctggccgcgcagcacgcctgttacgagtgtttcggcccgctcgaggtggcctacgacgaggcggctctcgcgcgggtgacccgggccgagatcgaggcgggtccgcagaacatctggcgttacgcagcgctgctgccggccggccaggacccggccacccgggtgaccctcgaccccggcctgactccgctggtcagcgccccgcagctggccgccgagctgggcatcaccgcgccgctctgggtcaaggacgactcgcagaacccgacccactcgttcaaggaccgggtcgtctcggtggccctgaccgccgccaaggagctgggcttcacccggttctcctgcgcctcgaccggcaacctggccaactcggtcgccgcccacgcggcccgggccggcgtgcccagcatcgtcttcatcccgggcgacctggagcagggcaaggtcgtgatgagcgcgatctacggcggtgacctggtcgccatcgacggctcctacgacgacgtgaaccggctgtgcagcgagctggtcgagaccgacgagttcgaggacaccgcgttcgtcaacgtgaacgtgcgcccgttctacgccgagggctccaagacgctgggctacgaggtggccgagcagctcggctggcggatcccggcccaggtggtcatcccgatggcctccggcgagctgctcaccaaggtggacaaggcgttcagcgagctggtcgagatcggactcgccgaggcgccggagggcggctggagggtgttcggcgcccagtctcagggctgcaacccgatcgcggtggcgctgcacggcgacaccgacgtgatcaccccggtgaagccgaccgggatcgccaagtcactgaacatcggcgacccggcggccgggccgtacgcgatcgaggcggtccgccgcaccggtggctggatggactacgcggacgacgacgagatccgcgccgggatcagcctgctggcccgcaccaccggcgtgttcgccgagacggccggcggcaccaccgtcgcggtgctcaagaagctggtggagagcggcaggctggacccgacccgggagaccgtcgtctacaacaccggcgagggcctgaagacgctggacgcgatcgtcggcacggccggcccgacccaccggatcaagccgtcgctgcgcggtgctcgcgaggccggcctgctgggatgactctgggtgaccggctatctgccggttgtcgagaattcctaccgcggaggacttgcgcgccgatctccggatcgacaaaatgcttctcgcgggaggacgcgacgccgtacgaggcccctcacctgagcttggcgacaatctccgagggtcccaacgacccagcgctgacccaatggccacgtgccggaggcgctgtgcgtccgtcctcccgaccaactaccgcttcagccgctgcagccacgggcgcagcggcagatcctcgggatatccgccgtccttcaggccggcgtgacgctcgaagaagttgcggacgccgtacgagccggtcgccgtgaacgaccacccacaagcgacccagtacgccggccagaacagcggacccagcaccgcgtactgcccggcgtgccggctctcgtgggcgagcagcgcggcccgctcctcggcgagcagccactcggcgctgcgccgcgtgatgatcaccgagccgaccgtgaagcaggacgccgggggcatcggcaaccgccagccctcggcgatcagcaccccgtcgcgcccgcggcggaccctcgtccgggtgatcagggccagcagcagcccggcgccggtggtcccgttcaccgcggtcagcagcgtccgggcgacatgccaccggccggccatcagagccgccgtctcatctggagctcggtgagcaccggcacggtcgggtgcggcagccgcaccccggtgtcctggaagccgagtttctcgtaggcccggacggcccggtcgttgccggtcaccacctcgagcatcagctcgtgccgcccggccgcggtggaccagtcggcgatcgcctcgatcaggctggccagcatcttgccgccccgggcggccggcgtcaggtagaccgagaagacgacggtgaccagcggatcgtccgggatcgcggtgccgccggcgtgcccgagcagcggcccgtcgcccggatcggtgacgaactgggcgagctccggcccgtcggcggccatgtccagccgccgccggtaaccctcgtgcgagcgggcggcggcctgggcgagggtctccaggaaggcgagcggactgtcggccagcatctccagccgcagggcgcgcatccgcccggcgtcacgggcggtgatccggcgcaccatccaactctccatgcgtcctcagtactcgccacggcgggttgcggcaagcatgttgccgcaaacgggaccctcccacctgcggttgaagatctttagtcggtttgcgggccgggcaccggggtttcgcgggaagatggggtttcttgcactcggtacccgggagtgctaaacaagtgattggcactcacgaggtgtgagtgccagcaggtcgggacggtggggttccggtcgcgacgccgccatcggcgccgcgacacgaaaccggtcgtcgcgggctatccggctcggcctgaggacgtcacatcgccaggtggtgacgtccacagacttcctcaaagagtgtgcgggagcgggtcagaccggccctcacccgcgaatgtccaggaggacaacgccgtatggccaagatcatcgcattcgacgaggaggctcgccggggcctcgagcggggcatgaaccagctcgccgacgcggtcaaggtgaccctcggcccgaagggccgcaacgtcgttctcgagaagaagtggggcgcccccacgatcaccaacgatggtgtatccatcgccaaggagatcgagctcgaggacaccttcgagaagatcggcgccgagctggtcaaggaggtcgccaagaagaccgacgacgtcgccggtgacggcacgacgacggcgaccgtcctcgctcaggcgctggtccgcgagggcctgcgcaacgtcgccgccggcgcgaacccgatggccctgaagcggggcatcgaggccgcggtggccagcgtctccgagggcctccagcagctcgccaaggatgtggagaccaaggagcagatcgcctccaccgcctccatctccgccggtgactccacggtcggcgagatcatcgccgaggccatggacaaggtcggcaaggaaggcgtcatcaccgtcgaggagagcaacaccttcgggctggagctggagctcaccgagggtatgcgcttcgacaagggctacatctcggcgtacttcatgaccgacgccgagcggatggaggccgtcttcgacgacccgtacatcctgatcgcgaacagcaagatctccaacgtcaaggacctgctgccgatcctcgagaaggtcatgcagtccggcaagccgctggtgatcatcgccgaggacgtcgagggcgaggccctggccaccctggtcgtcaacaaggtccgtggcaccttcaagtcggtcgccgtcaaggcccccggcttcggtgaccgccgcaaggccatgctggaggacatcgccatcctcaccggtggcgccgtcatcagcgaggaggtcggcctcaagctggacgccgccgacctgtccctgctgggccaggcccgcaaggtcgtcatcaccaaggacgagaccaccgtcgtcgacggcgccggcaacggcgagcagatccagggccgggtcaaccagatccgcgccgagatcgagcggtccgactccgactacgaccgggagaagctgcaggagcggctggccaagctggccggcggcgttgcggtgatcaaggtcggcgcggccaccgaggtcgagctcaaggagcgcaagcaccgcatcgaggacgctgttcgcaacgcgaaggcggccgtcgaggagggcatcgtgcccggtggtggcgtcgccctggtgcaggccggcaagaccgcgttcgacaagctggacctggtcggcgacgaggcgaccggtgccaacatcgtcaaggtcgcgctcgacgccccgctgcgtcagatcgccgtgaacgccggcctcgagggcggcgtcgtggtggagaaggtgcgcaacctcgaggcgggtcacggcctgaacgccgcgaccggtgagtacgtcgacctgctggccgcgggcatcatcgacccggccaaggtcacccgctcggcgctgcagaacgccgcgtcgatcgccgcgctgttcctcaccaccgaggccgtcgtggccgacaagccggagaagaacccggctccggccggcgcccccggcggcggggacatggacttctgagtccggtgaaaccctgacgggacgggcgggccgcgttcagcgggccgcccgttccgctgtttccaggggcaggtcgcgcaggccgcgtaccggtgaccaccagtagatcatcggcgagatcgcggtgcacgccccgaagatcagtttccccggcgcgttcgcgcccgaatcgcacggctacccgccgcgctgggccgagatccccggcacccgcggctgcaccctggaagccctcacctacgccgggcgggccgaccggttcgccgccgccggcgcccggatccgcggcgtcagcacccagcgcgccgaccagctgcgcgcgttcgcggcacacgccgctctgccttacgagctgctctccgacgctgacggccggctcgccaccgccctgcggctgcccaccttccgggccggtggcggcgaccgcctcaaacgcctcaccatgctgatcgacccggccgggacgatccgggacgtgcggttcccggtcaccgacccggccgcgtcggtcgacgagatgctcgacctcctcggcggatactcgagtggggcaggccacattcccccgccagggtgaccccggggagggctaacctgggacgggtgcgtgatccctccgtctcccgctacacggccggccgtctctccccgatccgccgcaccgccgacctgcggcggctccgcgacgaacagttcgacgtcctggtgatcggcggtggggtcaccggcgccggtgcggccgtcgacgccgcctcccgcgggctgaaagtggccctggtcgaggcccgggacttcgccgccggcacctccagccggtccagcaaactcatccacggcggcctgcgctacctggagcagctcgagctgcacctggtgcacgaggcgctcaccgaacgcggcctgctcgccacccggctcgccccgcatctggtccgcccggtcccgatcctcgtcccgctgcccgccgccaacccggtcaaacgggtctggcagcgcggttactacgggctcggcgtcgcggcgtatgacgtcttcgccggcgtcctcggcggcggccgcggcatgccgctgcaccggcacctgagccgcgacggcgcccggcacctgttccccagcctgcgcgccgacaagatcaccggcgcgatccgctactacgacggccagatggacgacgcccgcctggtggtcaacctggcccgcaccgccgccgcccagggcgccgcagtggtcaccagcgcccgggtcaccggcttcgtccgggaggcccgcgaggtggtcggcgtccgggtcaaggacctggaatcacccggctcacccgagttcgaggtgcgcgccaagaccgtcgtcgccgccaccggcgtgtggagcgacgacatggcggaaatgctgcgcgacgtcggcgtccgccccggcctgcgggtccgcgcctccaagggggtgcacctcgtggtgccccgctcggcgatcaccggcgaggccggcctgatcctgcgcaccgccacctcggtgctgttcgtgctgccctggggcggccactggatcatcggcaccaccgacaccgactgggagctggaccgctcccatccggccgcctccgcccgcgacatcagctacctgctcgaccaggtcaacacgattctcgaccggccgctgaccaccgacgacatcgagggcgtctacgccggcctgcgcccgctgctgtccggcgaggccgactcgacgtcgaaactgtcccgcgagcacgccgtcgtcgaaccgatgctcggcctgctgctggtcgccggcggcaaatacacgacctaccgggtgatggccgccgacgtcatcgaccaggccgtccgccgcctcggcggcgccttccgcccgtcgcgcaccgaccagctcccgctgctcggcgccgacggctacgccgccgcctggcgcgaccgccaggacaccgcccgccggcacggcgtcaccaccggcgtcatcgagcacctgctggaacgctacggcaccctgaccgtccacctgctcgccatgatggccgccgacccggcgctcgccgtccccctcgaaggcgccccggagtacctggccgtcgaggtcgcctacgccgccctcgccgaaggcgccctgcacctcgacgacgtcctcacccgccgcacccgcatctccttcgaaaccgcccaccggggcgtcgaatccgccgcccacacggcccgcatcatgggcgccgtcctcggttggaacgagaccgtccgcgaccgcgaggtcgagcactacctggcccgcgtcaccgccgaacgccaatcccagaccatgcccgacgatttgaccgccgatgccgcccgggtcggggctcccgacgtccgcggtttggcgggagaccgcgcacaccctcccgccgccgcttcccacctggaagccgccgcgtctccgcatccggaaactgccgcctcccacccggaaaccgctgcctcgcatccggaaaccgccgcgtctcacccggaaaccgctgcgtctcacccggaaaccgctgcgtctcacccggaaaccgccgcctcccagctggaagccggcgggtctccccgcccggaggccggcgggtctgcccaccctgacaggaccggccttctcgaagccgaacgttgatcctcgtcgacgagccgcgctggccgggccggggccacctctggtcccacctggtcagcgacgtctcctacgccgagttgcacgccttcgccgaaatgctgggctccccacgccgcgccttcgaccgcgatcactacgacatcccggcagcccgcttccgcgccgccctctggctcggagcaaccctggtgccaccccgggaactgaccgcacgcctgcgcgccgccaatctccgtcgccccaaacacctggccggcgggagcctccggaccgcttcccggtgacccggacgacctctgcgctgccttgcggcgccctccctgcccgactttgaagatcaacttcaagatcaaatgcttgatgtcgtgcgctgcggccgataactgaccgccgctcccgccgagggcacctgcgggccgagctggccgctacgcgtccagaacgctcggccctccggcgctacatccgcgtgtgcccaccgaaacccccgccccgcccgggcgagggactccgggcggctcgaggcgcgtgtggtgctaggacggcattctgcggcccggtgttgtggcccgaggcggtgtgcggtggtgaggcggcgcgctgggtttggggcggtgaggttgcccgcggtgtgcggtggtgaggcggccgcccgtggtgctcgtcgggcggggcggtggtgaggtcggccggggtggtgaggaacggtccgccgagtcgtggtggcgaacggcgaggtggggcggggcggcgggtggggtgggcggccggggatggtgtgtggccggaggacggtttgtggctgggggatggtgtgtggcctggggatgtgtggctgggggatggtgtgtggcctggggatgtgtggctgggaaatggtcctgtggctggcgtgggtcaggacgggtggccggcggtgacgacgatggcgtcgggggggatttctgggcggcggcgggagaggcggcggattccggtgttcaggacggcgatcagggggaccgctaccagggcgccggtgatgccggccaggaccacgccgcaggcgatgccgatgatgacggccaaggggtggatggctaccgctcggcccatgatcaagggctggaggacgtggccttccagctgctggacgaggatgaccgcgccgagggtgatcaaggcgacgacccagccctgaccgacgagggcgaccaggacggctaccgcgccggagacgccggcgccgacgatggggacgaaagcgcccaggaagaccagggcggccagcgggaacgggaactggacgtcgaggatcagcagggccaggccgatgccgaccgcgtcgatgaaggcgaccaggacggtcgcgcggacgtaggcgcccagcgtggcccaggaggcgtcgccggcgtcggccagcgaccagcgggcgctgaccgggaacagccggacgatgaaacgccagatcttgtggccgtcgcggaggaagaagaacgtcgagaagagcaccagcagcaggccggtgagcagctcgaagacggtggcggcggtggagatgccggtggaggtgagcgacgaggtgttgtcgttcacccagctctgcgccgaatcgatggcccggtcgacctgcttgtcggacaggtgcagcgggccggtcttggcccagtcctggatctgccggacgccggcggtggccttctcggtcagctgcggcaggccgtcgatgaactggttgaccaccagggtcagcgtgccggcgaccgcgcccaggccgcccaccagcaccaggaaggtcgccagcgagcggggcaggtgcagtttgcgcagccagccgaccgcggggccgagcagcgcggtcagcagcagcgcgatggccagcggaatgaccacgacatcgacctggctgatgaagcgcaggccggcgtaaccgaccaggccgaccacgatcagccgccagctccaggccgccgcgatccgcagcgagtgcggcacgtccacgtcgtcgaggctggtggtggagccgtgcacgacggcgggctcggccgggaccgcgacgaagtcgtcctcctccggctccggctcgggtcgtggccggtcgatgcgggtcacccgggccgcctcccgtcccgtgtcgtaggccttcctcaggttttcccggacacgctgcaagcggttcaaccgccgaccccctcgccggattcgcgttacgcgaccatcacggtagtgggcccggcccacaaccgtgacaccccgccccatgcgacgcgatccggaccactcggaccggcggcccgggcaccggcgtaccgtctgctttcgtgagtgccgataccgcccgtaccgagaccggactgccgatccggatgcttcatgaccgtgtcctcgtccgccaggacggcggcgagggcgagcgccgctcgaccgcgggcatcgtcatccccgccaccgcctcgatgggccggcggctgtcctgggccgtcgcggtcggcgtcgggccgaacgtccggtcgatcgtcgtcggcgaccgcgtgctgttcgacccggacgaccgttccgaggtggagctgcacggcaaaggctatgtcctgctgcgcgagcgggacgtgcacgcggtcgcggccacccgggtcgagtcggacgggaccggcctctacctgtagggcgggtactgccccggatactgcggcggcccggaagcgggcggcgccgagtgcggcggcgccgagtgcggcggggcggacgaaggcggcccgtaggcggccggcggcccgtaacccgaaggcggcggcgcgaacggcggcggcccgtatccaggcgcgccgtatccaggcgcgccgtaaccgggtgcgccgtaaccgggtgcgccatggccgggcgccccatatcccggcgttccgtagggaccctgcgcccccgggtggccgggcccgcccgggtagccggggccgcccgggtagccggggctcggctgaccccacccgcccgcatacgccggcatcggcggcggaagccgcaccggcaccggcatcaccggctcggccggcgccgtcaccgtgcgcaccaccccgtccggaaaggtgatccggtacgcctgcccgtcccaccaggccggcggcgtctgcgggtcccgtccggcgaagaccgcgcggtagccgacgatcgcggcgagcagttcgcgttcctcgaggaccgccttggtcatttctttctggtcgccgttgagcccgcgctgcatgccgtcccggatgatcgccagccgggtcgcggcgaactggaagctgcgcatcgcccggttgccggccggcccggcgacccgcttggcccactgccgggccgagtgccggcggccgaggctgcccagcgcggccacctcgggcggcgcgaaccagccggtgtgcacgtagtggtgcagcacccgctcggccaggcggccctcccagctgcgcagggcgatggcgaaaccgaccacggcgaagaagaacggcaccatgaagccgagatagccgtacagcatgatcaatgatttgccggtggccgcggagagcgtgggcagcaggttgaacgtgccgtgcaggatcatcgcgagcagccagccgccgaccggggccagccaccggacgtgcttgtccgccgagcgggacgagatgcccaggccgatgccggtcatcgaggtgaacagcgggtgggcgaagccggtgaacaggatccggacgatgaagatcaggaagacgttggtcaggccggtggccggcccgtactgctgggcgcccgcggcgtagccgtgcccgcccaggtagagcacgttctccaccatggcgaagccgagcgcggagaggccgcagtagacgatgccgtcggtgatgccggaccactcggcgcgccgccgccagaacagcaggaccgggccgagcgccttcatcgactcctcgatgaacggcgcgaccagcaccgcgaccagggcgtccggcaggccgatcttgtcgaacagccaggaggcgccggtgttcaccgcgagcgcgaccgcggtggccaccgcggcaccccaggcgaagcagaagatcaggtatttgaccggctccggctcgtagcggtcgagccaggcgaacgcgctggccagcagcggaaccgggaggatcgcggcggtcaggccgacggccaggccggcgatgccgatgctgtagcccaggaagatcagcatgccgatggcggccgcggcgatcagcacgatcacgccggtgaccgggacccagcggcgccagccggcccggcggcccgggatcggggcgacggtctgcaccatctcggtggggaacggcggcaccgcgtcggccggcacctcctcggcggtcacccggccgggcgcgtacaccggcggggccggaaaggtggccggagaggcggccggggacgtgccgggatccggcgcccccggagcggagaccggggatgcgcccggatccgccgcacccggcgaggtgaccgggaatgcggccggcaacgcgcccggaggcgcgccgggatccggcgcccccggggagggcgccggcaacgaggtgggcgccggatcgggcgacccggtcggaacgtcggccatgcccgccagcgtagtcaccggcgccgcgcccggcgcccccgaggagcgcggaaacgatcacccgaggccggggtgccgggaccgcccggtccggttgcgcgccccttgggcgcgtccggaccatccgacggcggcgcgcacctggagggtggcctcggcatactcgaccccggtggcgcgcagcaggtcggccaccgcggtgcggatctgggccaccaccacgcccccggagtagccgaccccggtgtcgtaggcccgcccggattccgcggcggcccgcagcgcgcgttcccgggcggcgaccgggggcacgccgcgcgcccattcctggcggagcagatcgaccgcgtcgcccaggtgccggaccgaggcgggcagcacctcggggacgcgttcccggtcgttcagcgcggtctgcgcgcggcggatcatcacccggacgttgcgcagtgcgtaggtgagctgggcggcgccgtcgacgtactgggcgagggcaccccgattgcgccagcgggccggggcgaaggcgacgttctcccgggccgcgtcgatcgcggtgcggaagttcgcgaaggtcgcctcggcggcccgcaaccggctcagcgccgcttcgatcacgtccgggtcgccctcggcgagcccgagcgcggcctcgtgcagcccggcggtgaaggcgcgcagcgccgggtccgcggcccggcgtaccacgctgagcgggttgagcggcagcagcacggtcatcacggtcaggccgatcccgccgccgaccagggcgtcgaagaaccgggtccacgggtgtccggtctgcacggtgagggtcgccaccaggaccgcggacgaggcggactggacgatcagcggcgagccgccgccggccgcggtcgccaccagcacggccaggatcacgatcagcccgatctggaccggcccggtgccgatcagcaggatgatcccgtcgcccacgccgatcccgaccgccacaccggcgacgagctcggcggtgcgccggacccgctgcccgaccgaggaggccagggtgatcaccgcggcgaccggggcgaagaacggcgcgggccggccgatcaggtgatgtgcgacataccacgccaggccggcggccaggccggcctgcaccgccagcatcagcccggcccgggcccgcgccgtggcggcgcgcattccctccgttgcgatgccgatcatgcttgcgacctccgtgccaggatgaccactgtgacatctttgcccgaccggttccgggcggcggcgcgcggcgccggcgccaccgccgccgacgcggatctcgactccgccgcaaattacctgctgacccgctggaccgagccgcaacgccactatcacgacgtgacgcatctggcggcggtgctggaggtgatcgacgagttcgccgggctggcgccgcatccggaccgggtgcggctggccgcgtggatgcacgacgcggtctacgacccgcgggcactgggcgatgcgaacgagcgggacagcgccgagttcgccgccgggctgctggtcacgctgggcgctccggaggaggtggcggccgaggtggcccggctggtcgggctgaccgccgggcacgccaccgaggagaacgacccggacggcgagctgctctgcgacgccgacctggcgatcctggcggctgacgaggagcggtatgcccgctactgcgcggcgatccgtcgggagtacgcgcacgtgccggacggggatttccgggccggccggtcgcgggtcctgaccgagctgctgaagctgccgtcgatctaccggctggcgccgatccgggacgcgtgggaggcgcgggcgcaggccaacctgaaggcggaactcgaggcgctggcctgacgcacggctgcggccgctcccggtcgggacgattgcccggtacgcaggtccgcacccgccgcgcgccgacccgccggaccgtgcgccctagctagctagcgcggtatccacgcgcgccgtgccggcgacgcgcggtgggacggtgctcacgtcgtacaccggcaggcgtttgatcctgatcggggaaacgccgacgggcgggcatcccggaggagtcccgcccgtcgtgacagagcgtgggtcaggcggtggcgacgctgaacgagacctcgttgacgccgcgggtcgcgtcgaccgcgagctcgccgttgccgaaccggctgagggcgcgcagcgtccacgagccgggggcggcgaagaagcggaagacgccctccggggaggtgacgacctcggcggtgaactcgccggagccgtccagcaggcggacgtacgcgccgcccaccgcctcgccctcggcggtgcgcacgatgccggtgatgacggtttccttctccaggtcgacgctcgcggggaggggagcggactggtcaggagcggcgcagctggcggccgcgttggcaacaggagaggtcatggtgatcaggcctttccgggctcgtcgccgagggcgatcggcacgccgatgagggagccgtactcggtccaggaaccgtcgtagttcttgacgttctgctggcccagcagttccttgagcacgaaccaggtgtgcgaggagcgctcgccgatccggcagtacgcgatggtgtccttgctgccgtccaggccggcgtcgccgtagatcttggcgagttcctcgtcggacttgaacgtgccgtcctcgttggcggccttgctccacggcacgctgatcgcggtcgggatgtgcccggcccgctgcgactgctcctgcggcaggtgcgcgggggcgagcaggcggccggcgaactcgtcggggctgcgcacgtcgaccaggttcttcaccccgatcgcctggacgacctcgtcgcggaacgcgcggatctccaggttcggcgccttggcctggtacgacgtctgggcgcggctcggcgcgtccttggtgtagacgcgggcgtccagctcccacttcttgcggccaccgtcgagcagcttgaccgactcgtggccgtacagcttgaagtaccagaacgcgtaggcggcgaaccagttgttgttgccgccgtacaggatgacggtgtcgtcgttgctgatcccgcgctcggacagcagcgcggagaactgctcctggttgacgaagtcgcgacggaccgggtcctgcaggtcctgcttccagtcgatcttgatggcaccggggatgtggccaccgtcgtacgcggtggtgtcctcgtcgacctcgacgaagacgatgcccggggtgtccaggttcttctcggcccagtcggccgaaacgagtgcgttgtcgcgactcatcggttcactccctgaaaagtgggtgaggagagagtcagcgcacggagacttgtcgtcgcactccgcgcggacccatggagatagtgggatcacgggtttgctgtgcgacggcgccactgccggacaagaaacgtcccgggctatcgagagaaggtgctcagcacccagcggccccgtcggtcagacggagcgacacaggcacgcggccacgcgacacaggtcgatcgcgcgccttttcgtgagcaacaggctcatgtccgcgaccctaccagcggttccagagcccggaacagagccgaccacgatccgggacgagtcgcgggtcacaggccgccggcgttgagattcacgttctgcgccccgaactggactttcagcccgtcgtcgccggccgcgacggattgcaccctgagttgcagcggcagtttcggcacggccagatcgagggacatccgctgcgcctgggcgtcgatcaggttctggatcagcgggacgttcggcagattggtggcccgcacgtcggagaaccgcacccggatcccgccgtcgaccacggtgagcttggccgcgccggtcagatcgacctgctggccgagcgcggtgacggtggccgcgccgatcagcttgccgtccttcgcggagagcttcacacccttctgcccgatcagctcgaccaactgcgggtagtcgatcgtgctgaccccggtcacggtgccgaccaccacgtcgcccgagccgttgcgcagcgtgtccagcgacgccttcacgtcctgcgcgtggatgtcgagcagtgccaggttgatcttccgggtcttgtccaccggggcggtgaggtgcggcacctcgatgtggatttcctggtagtgcccgtcgagcacctgggtgacgaacgggaagccctcgatggtcacgtccggggtgtcactggacgccttctgtgcccggatctgcccggcgaccttgtcggagatgacgccctcggcgaacgaccggccgaagcgatccaccacgaacgcgacacccagcacgatgaccagcaggatgaccagaatgatcagcacgccgcggccccgccgacggcgacgcggagcggtctcgtacacctcggccacagggccctcccggttcgtgaactgttgaggaccgtacatgccccggtccaccggatcgcgaaacgggcaggcgtcaggtgagataaaggtgcaccagcagataggtggccacaaaggtgagcgcgaacccgcccagcggaccggtcatgtgccgggccagccacagcgtcggcgcctcaccggccagccggcggcccgcctcgccgaagttcaccgccaggtcgaccaggatcgcggcgaccgccgcgaccagcccggtcaccgcgcccttggccgggttgaacgggtagaccagctggctgcccagccacgcggtgaagaaggtgccggccatcgcgcccagcaccacgccggccgcgccgcgcggcacctgcggggcgatccgcggtttcgggaacaccgcgtcggccagccgggcgaccagcaccgccagcccggccccggcgcagcagaccaggatcgcctgcgagcccagggactggcggctgagcacgatcgggatcgcgtacgccaccacgccggcgacgatcagcagcgtggtccgccaggagtcgccgatccggtgccggtcctcggcgcggaccgcctgcgcggccagcgcggccacgaaaccgccgccggtgacgtagagcagcggggtcagcccggcggtgtccgcggtggcggccagatagcaggcgaccaggccggtcagcccgctggccgcggcggtcagcgaggcggccggcgggctcagcgccatggtccaggcgagcaggccgagcagctggatgccgaagagcacgatcgcgtacggcgtgcgcacgcccggcccggtggtcagcgtgccgaggatcagcgccagtgcgagcagcgccgcgaacccgccgatcgccaccgacagcttgcgtcggaccgggacgacctcgatctcctcgaactcgtcgtcgaagtcgtcgcccggctccgaggtgggccgctcgtcgggctcgtcgtccggcacggcaccgtacatcccggctttggggcggcccgggttgaggcgcgcgacgtcacgggaggcgtcggcgtcccaggggtcgtcctgcggcatggaggggaacacgacagcgatcgtgccagagtccggcccccggcccaatccgccgccctatgtaaaaggcttgttaagaaccgggcgttatgccacttaccaggcgttctctgcgtcacttgcgggtttgaaccggtcgtcaggacgggtggatcggttaaggtaacggcaacccacccgtcggtgacgccgggccccagttctccgggatagcggctctgagctgcgcattccgggtcacccgagcggccgtcagacgccgcgaggacggaggtgagtgtggagatccttctgttggtgacggcacgtgccggtgagccatccgccgtgctgcccgccctggacctgcttccccactcggtcaggaccgccccgcgcgacgtgcgcaccctggtttccgggccgagcccggacgcggtgctggtcgacgcccgctcggagctctccgaggcgcgggccacctgccgcatgctgcacgccaccggcatcggcgtcccgctgatcgcggtggtcaccgaggccggcctgatcgcgctgaacgcggactggggcgtcgacgacgtgatcctggccagcgccggcccggccgaggtcgaggcccggctgcggctcagtgtcggccggctcaccaacgcgaccgccggcgccggcggctcgatccgcgccggtgagctcaacatcgacccggacacctacgccgcgaagctcaagggccgcccgctcgatctcacctacaaggagttcgagctgctgaaattcctggcccagcacccgggccgggtgttcacccgcgaccagctgctgcgcgaggtctggggttacgactacttcggcggcacccgcacggtcgacgtgcacgtccggcgcctgcgggccaagctcgggtcggagtacgagtcgatgatcggcaccgtgcgtcaggtcggctacaagttcgtggtcccgccgtccggccggcagctgcccgacaacgcgccggtgtcgctgccggtctaagttcggttccatgcagagattgcccgccgccgagatcgacgctgtcctggccctgaccgaggcggcgggctatccgctctccgaggatgtcgagctgcgcctgcgcaacggcggcggcgatcacctcctcgcacacgccgcggacggctccctggccggctacgccttcctcgaggacggcgccggcgagctggtcgtccacccggcgcaccgccgccaggggcacggcagccggctgctcgacgcggccggcccgggcgagctccggttctgggcgcacggtgacgatcccgccgcccgggccttcgccgagcggcgcggcttcctgcgcgaccgggtgctctggcagatgcgccgttccctgctggagccgctgcccgacatccccctgccggccggggtgaccgtccgcggcttccgccccggctccgacgagcaggcctggctcgaggtgaacgcgcgggccttcgcccaccacccggagcagggccgctggactctcgacgatctgttgctgcgcgagggcgagccgtggttcgacccggccggtttcctgctcgccgtcgacgtgacggaccggctgctcggcttccactggaccaaggtgcacaccgacaccgacccgccgctgggcgagatctacgtgctcggggtcgacccggccgggcaccggcgcggcctgggcgcggcgctgagcgtggccgggctgaagcatctcgccggccgcggactcgaggtctccaacctctatgtggacgagtcgaacaccgctgcggtgcggctctaccggtatctcgggttcgaggtccaccacgcggacatcaactaccgccgccccgcttgataacggcgcggccaaggcagtgtctcggtagagtcacgaggtgacggtatatccgacatatcgggtagcaagagcgcggttcacttaacggacaactacccctcagggcaaggccaccttctggggtcgacgagttcacccccagttcatgtgcgcccggctcgcaggtcatctggcactcctagttttcccttcgagccggtgagcgaccggcccgccttgaacccgaaggggactacaaccgtgaagttccagcggtccggtcttgttgccggcattgctttgactgcgaccatcgcgctcaccgcgtgcggctcggacaacaccgacaccaagggggacaccggcgccgccgccccgtccgccggcacctgcgttggtggcaccctggccgctcagggctccagcgcccagaagaacgcgatggccgaatggatcaaggcgtacaccgcctcctgctcggccgccaagatcgactaccagcccaccggttcgggcgcgggcgtcaaggcgctgatctccggtctcgccgacttcgccggctccgactcggcgctcaaggacgacgagcagccgcaggccgacgccaagtgcgcctcgccggctctcaacctcccgatggtcgtcggtccgatcgcggtggtctacaacatccagggcgccgacggtctgcagctgtcgccgagcctgatcgcgaagatcttctccggcaagatcaccaagtggaacgacccggccatcgccgccgagaactccggcgccaagctcccggacgcgaccatcgaggccgtgcaccgctcggacgagtcgggcaccaccgacaacttcaccaagtacctcagcaagaccgccgagggtgactggacctacgaccacgccaaggcgtgggcggctccgggcggcaccggcgccaagggctcggacggcatcgccgccaagctgaagagcaccccgaacaccatctcgtacgtcgagctctccttcgccgagaacagcgacctgcagaaggccaagatcaagaacggtgccggcgagtacgtcgagctcaccggcgacgccgcgggcaagaccatcgagggcgcgaaggtcaccggcaagggcaacgacctgaagctggacatcgactacaagaccgcgaccgcgggcgcctaccccattgtgctggcgacctacgagatcgtctgctcgaagtacgccgacgccgccaagggcaaggccgtgcagggcttcctgaagtacacctccagcgccgagggccagaagaagctggccgacctgggctacgccccgctgcccgagtcggtccgcaccaaggtcgccacctcggtcgccgctctctcctgaaccaccccccggttcctgaatccctccgagacgacagcgagcgcgtagatgggtgactatccctcccgctcggcgaacgccaccgccggtgacctgggcgtgactccccgtcacgcccggggcgccggctctggcgtgtccccgagcagttacgaagagcccccggtcggtggcggcggcgccctgcccaagaaatcccggttctccatggagaccggattccgcggtctctccctggccgccggcacgatggtgctggtcatcatcgtcgcgatcgccgtcttcctgatctcgaaggcagtgccggccatccgggccgacaaagagaacttcctgacctacaacttctggcggccgaacgaggccgagccggccttcggtgtcgccgtcctggccttcggcacgctgctgacctcggtcatcgcgctgatcgtcgcggtgccgatcgcgctgggcatcgcgctgttcctctcgcactacgccccgcgccggctggccaccccgctcggcttcgtgatcgacctgctggccgcggtgcccagtgtcgtcttcggcctgtggggccgtgacgtgctgcaggagccggtgcgggacttctcggcctggctcaaccactacttcggctggctgccgatcttcggcggggacggtccgttcggacagtcgatcatgctcggtggcctggtcctggcgatcatggtgctgccgatcgtcacgtcgctgtcccgtgaggtcttccagcagacccccgggatgaacgaggaggccgcgctcgcgctcggcgccaccaagtgggagatggtccgcaccgcggtcctgccgtacggcaagcccggtgtgatcgccgcggtgatgctcggcctgggccgcgccctcggcgagaccatcgccctggcgctgaccctcggcatcacctggcagatctcgttcaacctgatccagaccggcggcaactcgatcgccgccaacatcgccaacgcgttcggcgaggcgaacgacaccggccgcggcgcgctgatcgcctccggtctggtgctgttcgcgatcacgctggtcgtcaacatgacggcgcgggcgatcatctaccgccgccgcgagttccgggacagtgccgcatgagcatcgtgatgacgccggacaacatccgcagcaggaagttcccggtcgccgccaacctggcggtcgccgtggccgcactgatcgtctccgccgtcgtggtgctcgggaccggcatcggcaactgggtgctggtcgccttcctcggcgtggtgttctacctggtcggcctcaacctggccgcgtcccgggtggagggcaggcgcgccgcccgcaaccggatgtggcagaccctcatctacaccgcctgcgtgctggccgtcctgccgctggcctcggtggtgtggacgctgctcgccaagggcgtcgaccggctcgacggcgacttcttcggctcgtcgatggcgaacatcggcgcccgcgacgcgaacggcggcgcttaccacgccatcgtcggcaccctggagcaggtcggcatcgccaccctgttcgccgtgccgctcggcgtactcggcgcggtctacctggtggagtacggccggggccggttcgccaccacggtccgcttcttcgtcgacgtgatgacgggcatcccgtcgatcgtcgccggtctgttcatcctctccttctgggtgctgatcgtcagcccctggttcaacaacggggagccggagtactccggcttcgcggccgcgctggccctgaccgtgctgatgctgccgaccatcgtgcgctccaccgaggagatgctgcgcctggttccgggcccgctccgcgagggtgcgtacgcgctgggcgtcccgcagtggaagacgatcctcagcgtggtgctgcccaccgcggcacccggcatcgtcaccggcgtcatgctcgccatcgcccgcgcggccggcgagaccgccccggtgctgctggtcgcgggtggcctcgcccggatcaacttcgatccgttcgccggcggtcagtcgtcgctggccctctacgtgttccagcaggcgggcgacgcctctaagtactcgccggcccgggcctggaccgcagcgctgacgctggtcgccctcgtgctgatcttcacgatcggcgccaagctgctcgcccgccgcaacaaactgacccggtagaagaggttccctcccatggccaagcgcatcgaggcgagcaacgtctcgtcctactacggttccttcaaggcgatcgacaacgtctcgatgatcgtcgagccgaagacgatcaccgccctgatcggcccgtccggctgcggcaagtcgaccttcctccggtcgatcaaccgcatgcacgaggtcctgccgaacgcgcggatcgagggtcgcctcaccatcgacgaccagaacatctacgacccggacgtggacatcaccgcggtccgccgcatgatcggcatggtcttccagcggcccaacccgttcccgaccatgtcgatctacgagaacgcggtcgccggcctcaagctcaacggcgtcaagaagaagtcgatcctggacgacgccgccgagaagtcgctgcgctccgcgaacctctgggacgaggtcaaggaccggctcgaccgccccggcgccggcctctccggcggtcagcagcagcgcctctgcatcgcccgcaccatcgcggtcgagccgcaggtcgtgctgatggacgagccctgctcggcgctcgacccgatctcgacgctggcgatcgaggacctgatgttcaagctgaaggaccgcttcacgatcatcatcgtcacgcacaacatgcagcaggcggcccgggtcagcgacaagaccggcttcttctcgatcgacaagaccggcgagcccggccggctgatcgagtacgacgacacgcagaagatcttcagcaacccgtcgcagaagaagaccgaggactacatcaccggccgcttcggctgaggtccgcccgttcaaaggcgtcgatctccgtacgcggcgatcggcgcctttgtcgtctcctcagaatcgcagggtcgccgtgccgtcgtcggtgacctcgatgcggggcatcaccggggtggccgcgtcacggtgcaccgaggcggccaccacgccgtcgatcgtgccgcccgccacgatctggtccagggtgtgccgggtcggcggcagcatcggcagatccgccgcatccgccggatcgatccacgccgtgcggtccgcctccccggagacgtcccgggcctcctgggcctccggcagcagagccacgaagaaccaggtgtcgaatcgtttcggctcgaactccggggtgatccaccgggcccacggcagcagcaggtcgtcgcgcagccgcagaccccggcgggccagcagatccgccatcgtcagctcccggcgcagcaccgccgcccgatcggactcccaggtgggatcgtcggcgtcggcgaccgtgcgatccggctcggcggccgggccggccagcaccacgccggcctcctcgaacagctcgcgggccgccgcaccgacgacggcgcgggcctgctcctcggacacgccgagccgccgggcccagtcgtcgcgcagcgtctccggccggtcggtggggtcgaccgcgccgcccgggaacgcgtagaccccgccgaacgccatcgtggtcatccggcgcagcacgtacacctggaagcggtgcccggcggccgggcggagcagcaccaccgtcgcggccggccgcgccggaaccggtgggccggcgaaatcgcgggcgcgctgcatcatcgcgggcggcaggggcatcggctcggtcacccgtcgatccttgcaccatcgcccgcctcacggcagccagccggccagtcccgccggcggaggcgggggacagggtccggtgggggcgatacggtactgatcatgacgggacagaacgttcgctggggcattctcgggctgggcgggatcgccgccacgttcgccgccgaccttccgctggtgccgggggcggaactcgccgcggtggggtcacgcgaccagaagaccgcggacgcgttcgcgcaacggtacgggttcgcccgggcgcacgggtcctacgccgcgctggccgccgacgacgaggtcgacgtcatctacgtggcgacgccgcacgcctaccaccacgcggcggcgctgcagtgcatcgaggccggcaaggcggtgctggtcgaaaagccgatcaccctggacctgccgaccgccgcccaactcgtcgaggccgcccggtcccgcggggtgttcctgatggaggccatgtggatgcgctgcaacccggccatccgccgggccgccgaactcgtcgaagagggcgcgatcggctgggtcagctcgatccacgccgatttcgggctgcagggtccgttcgccgccgaacaccggctgcgcgcgcccgaactcgggggcggcgcgctgctcgacctcggcgtctatccggtccacctggcccacctgttcctggggctgcccagctcggtgcaggcctgggcgcacctcaccccggaacgcgtcgacgaacacaccgggatcctgctcggctggcagtccggcgcggtcggggccctcacctgcagcatcaacggggcgagccgcaacgccgcgtcgatcaccgggacggacgggcggatcgacatcccgccgggcttcatggtgccgcggtcgttcacgctgagccggccggacaaggcgccggaaacgttcgagttcgacttcccgggcagtggctaccagttcgaggcggcggaggtgcagcgctgcctggcggcgggggagcgggaaagcccgctggtcagccagaccacgacgctcgaagtcatgaacctcctcgactccatccgcgagcagatcggcgtcatctactgaggcgctccggatgctccccgccccgcggtgggcgcggccttccggctgccgtcgcgggttcgtcgcgttggggttgcccggccgggaagtcggcggttgatcttcagatccggcctcggcggttgattcaggagaaggccggccggacgatggcataggccaggcaggcgatcagcgccgcgcccgggaaagtcgtcagccaggcgatgatgatgttgccggccacgttccagcggaccgcactgaggcgtttggtggcgccgacgcccatgatcgctgaggtgatcgtgtgggtggtggagatcggcgcgtgcaggacccaggcgttgaagtagaggaccgcgctggcgaccgtctcggcggcgaagccctcggccgggcccaagtcgatgatcttgcggccgagggtgcggatgatccgccagccgccggtgtacgtgccggcggccagcatggtcgccgacgcccagaacacccactccgggatgtgtgcagcgctgtcctggtaaccgccggtgtacagcgccaggacgacgatccccatggtcttggcggcgtcctgggtgccgtggccgatggccatcatggccgcggagaccgtctgggcgtgccggaagccgcggttgagccggcccgggtggccgcgccggaacgtccacatcagggcgatcatcgcggcgaagccgaggatcaggccgacgaccggggacaggatcatcgggagcaggaccttgccgacgatgttggcccactgcacggagccgatgccggcgatcatggtggcgccgaccaggccgccgaacagggcgtgcgaggagctggacggcaggccgaagaaccaggtgatcaggttccaggcgatcgcgccgaggacgccggcgaagacgacgcccagactcggaatgcccagcgggagggagaccaggccgtcaccgaccgtcttggccacctcggtgccgaagtgggcgccgatgaagttgccgacggcggccatgccgagcgcgacccgcggggtcagcgcgcgggtgctgacgctggtggcgatcgcgttggcggcgtcgtggaagccgttggtgtagtcgaagaccatcgcggcgacgatcaccgccaggacggcgacgagttccggagacaaggcctaggactccttgaccgctatggtctcgaccgtgttcgccacgtgctcgaacgcgtcgcaggccgcttccagttcgtcggcgacctccttcatcttgagcacggtgagcgcgtcgtactccccggagaagagccggacgagcagcatccgataggcccggtccccgtcgttctccaagcggttgatctcgatccagtactcctcgagacccttcatcgaccgcagccggggcatcgcctcggcggtgatcttcgcctgctggtcgaggaccgtgatcagctcgtgcatctcgcggggcagcgacggcagctcggtcaggccgtacaggtagagcaggttgccgaccgcttccaggtgatccatcacgtcgtccagctgggagccgagcgagtagatgtcggcccggtcgaacggggtgatgaaggtggagttgatctttttgtacagctcgtgggtgagcgcgtcgctgtcgtgctcgacgtcgctgagccgctcgctgaccgactggacgtccacgccgggcagagccagctcgttgagcagctcggtccccttcaccaggttgtacgaggccttggtgaagaggtcgtagaagacgccctcgacaggacggaatgagaacttcacggcgcggacctcgatcgacgggctttcgttggatctccgcacgcactctatcggtctatccgggttcacccaccggacacggggcgcaggtgccggaccagagcggtgagatcggcgtcggcgaccacgtccaccccggccgcgatcagctcggaccagaccgcgacccgggcccgccgcggcccccgcggcagcccgctcatccgcaccgcccgcccctcgtcgtgggcctcgcgtaccagcgcgtgcagcaggtgacgctcctcggcggtgatcggctcccggccgtcccagccgaaccggcgggtccacggctcgctcagcgtgggcaccaggtccagcggggcggccggcgagcccaggtcgtcgaaaccgccgtcggcgaacgcgtaccggaccggttgggcggccagcaggtcccggacgtcgacgatgccggccaccgtgacggtcaccacgcccggcgtgatctcaccgtccgcgccgcggctcagcagcgcggcatggtcgcgcaactgctggtccagcatccggtaggcgcgcagcagcggcccggtgtcccggctctccccggcgaactccaccaccagctggaacggggtgtgctggtcggcccagagccgtccggcggtggcctgggcgcgggtgaacagcggggccagcaccagccggcgcagggtccggccgggccgcggatcgcccgggccgaggaacagctcgccgtgcgggcccggggtgacccggacggtcatcccggccaggccggcccgcagcaccatcggcaacgggtcggtgacccggtccgggatcagcgcgtgtccggtggccagactgccgcgcgggcggcgggccagcgcgatcgacatcgcgccgccggcaccggccaggccggccaggctgcccgcgagagtcgccatgtcctgcacgtggtcaccaccccaaaataaccgaaaagtccggttctactgtggcacaggtgatacccgacgccgggcatcccgcgcagaattgctccatgccgtcggtcaccgcagacgagttcgagacccaccgcgcctacctgacggcggtcgccttccggatgctcggcaaccgcgccgaggccgaggacgcggtgcaggaggcctggctgcgctgcgcgcagcaggacgacatccgggatccgcgcggctggctgaccaccgtcaccggacggatctgcctggaccagctcaattcggcccgggtacgccgtacgtcgtaccccggcgagtggctgcccgccttcgcggtcgacccggacgccgacccggccctgtacgccgaacgcgccgaccaggtcagcgtcgccctgctggtggtcctcgaacggctcagcccggagcagcgggtggcgttcgtcctgcacgatgcgttcggcctgccgttcgaggaggtggccgcggtgctcgacacgacgcccgcgacggcccggcagcacgcctcccggggccggcgcgccgccgccgacgggcagatccggcacaatgccgggctggccgagcagcgccgggtgctgcaggccttcctgctggccgcgcagagcggcgacatgcgcatgctggccgcggtgctcgcccccgacgtggtgtcgatcagcgacggtggcggcgtggcccgcagcgcgctgcgcccggtgctcggctgggagaaggtgggccggctgttccacggcatcctcacccgccgtgcccacgaggtgagcgatctgaaggtcgacccggtgctggtcgagggcggtgccgcgatgatgctgcgcggccgctggccggacgggtcaccgttgctctcggtgatcaccgtggccgtccaggacggccggatcaccggggtcttcacccagcagaacccggccaagctgcggctagacgacctcttgtaggtgcttgcggtaatgcgtggcgaacggctcggagccgtccccgagccggcccatcagcaggcgggccgccgcgttcgcgttcatcaccaggtcgtccgggtagccgaagagcgtccggtgctcgtcgaactcgtcctcgtcccggagctcgaccaggccggactcgcgacgccgcaccacgtccagatccaggtcgacgatgtgcaccgtgtcaccctcccagcgggccggggtggtgatgtcgcagtagacctcgctggtccgcggcggcgggttgaacatccccgtccaccaggcgtggtgcgggacgagcaggacgaacgggatctgctccaccgacgggcggccgtggtagaccgaagcggtgccctgggtcacgccgacccagatgcccaggtcgtcctcggccaggcggcgggccggatagtcacgatgcgccgaaccgtcgtacttcgtgtagatgacccggaccatctcgctcggcatgggtgcaccctaacggtgacccggatatgtcggtggtgccgggtacggttcgtgcgtgcccgcagctaccaagaagaaggcgaccgccggacaactcctcgccgcggcggtcggcgccgtccccgggggctccgcccgcccaggtcaggaggccatggtcgcggccatcgagaaggccatcaccgatcgcgagcacctgctggtgcaggccggcacgggcaccggcaagagcctcggctacctcacgcccgccctgctcgtcgagggcccggtggtcgtctccacagccaccctcgccctgcagaaccagctggtcgagcacgacctgccccggctcgccgcggcggtcgagccgctgctcgggcgaaagcccagcttcgccgtgctcaagggccggcaccactacctgtgcatggccaaactcgagcacgccgacgagcaggcgcccaccgacacgctcttcgacgacgccccggcgcccaaggccgggcagtggctcggcgaggccggccggctcggcaaacaggtcgtccggatccgcaaatgggccgacaagacccagaccggtgaccgcgacgagctcgacccgggcgtcgacgacaccgcttggcgctcggtctccatgccggcccgtgactgcgtcggcgccgcccgctgcccctacgggcaggagtgcttcgccgaggcgtcccgggtgcgcgcccgcgaggccgacatcgtggtcaccaaccacagcctgctcgccgtcgacatgctctccgagcggcacatcatcccgccgcacaagctgctggtggtcgacgaggcgcacgagctcgccgagcgggtgtcgtcggcgtcgcaggccgagctcacccccgaggcggtcgagcgggccggccgccgcgcccgcaccctgatcccgccggccaccgccgacgcgctcgccgaggccgccgacgcgctcaccgtcgggctcgccgacgtgccgcccggccggctcaccgacggcctgcccgacgggctgcgccaggcggtcacgctgctcgagtcggccacccgggccgggctcaccgcgatcggcgacgtcaagtccgacgaccccgacccggtccgcaaacagcaggccaaagcggtcctcgacgagctgtccggcaccgcccagcggctcctggaggaggacgagttcgacgtcgcctgggtggagaaatccgagatcggcgccgggcgcaaggcgctcgtggtggccccgctgtcggtgcacggcacgctgtcccaggcgctctacgccgaccgcacggtggtcgccgcctccgccaccctcaccctcggcggccgcttcgacacggtggcccgctcgctgggcctgccggtcgccgccgccgaggacacctccggtgacggctggacctccctcgacgtcggttcgccgttcgactatcccaagcaggggattctgtacgtcgcggcgcacctgccccgcccgatggcctccgggctgcccgacgccgccgccgacgaactgctcaaactggtgcaggcgctcggcggtcgcacgctcggcctgttctcctcccgccgggccgccgcccaggccgccgaactgctgcgcgccaagaccgacctgccgatcctgctgcagggcgacgagaccctgccgatcctggtccgcaaattccgtgaggagcgaaacagctgcctgttcggggtgatgtcactctggcagggcgtcgacgtgcccggcgacgcctgccagctggtggtcatcgaccgcctgccgttcccccgccccgacgagccgctggccgccgcccgcgccgccgcggccgacgccgcccgccccggctccggattctcctcggtcagcgtgccgatcgcggcggtccggctggctcagggagtggggcggttgatccgctcgaccggcgacaagggggtggtggcggtgctcgactcgcggctggagacggcccggggatatgggtcgttcctgcgccgatcgctgccaccgttctggtacacgacgcggtcggaggtggcgatcggcgccctcgagcgtctcgccaagagctgacttcgggagctgtcatgaaacagatcgcctgcacccttctcgtcgccgctgacgggtcgctgttgctgcagctgcgcgacgacaaggcgccctacttcccgaacgtgtgggggcttcccggtggcgccgtcgagccgggggagacaccagccgaggcggcggcacgcgaactccgggaagaggcgagcctgcaggccgacgaacccctgcgcctgttcgagcggcaggaactgcccgccgagggccgggtgaagtactacttccacggccacaccgccgcgacgcaggcggacgtggtactcggtgagggtgcggcgatgctgttcgtgccggcggccgaagtgctggaccggccgttcactccgggcagcgcggaggtgatagcccgcttcctgggctccgcggaacaccgcgcggccgccggttagggccggtgcacggggcgtgtcaccatggctgccgtgacgggaccgggcgggaagcggcgacggtgggtggtcgccatggtcgcggcctggatcctggggctcaccgggctgtcctggtggtcgatccgcaacgacccggcgaccgtgccggagcagcgggatctcgggcaggcggtgccggccctgcggaaagccaccgggacgctgctcgcggcggcggacgggccgtgggcgatccggctggacgcgctgcggaccgagaaatgccggctcaccccggtgcgggacgggctggacgccaaacgggacctcgtcctgtatgtgggggagggccagacccgcgccgcactcgaccgggtggccggcgggctgccggacgggttcaaggccggggtgaccccgagccgggccggaagccggctgtcgttcttcgccgacgccggtgacttcatcgcgatcgagggcgaggccggcgccgccgatcagatcctgacactgaccctggacaccgggtgccggccgggacccgcgacgctgggcgcggatccggcggcgggcgcggcgccggccgtgttcggcaagacggtcgcggcgctcggcgctagctagctagcaggcggcggcctgccccgagggcggaacggcggtgaccctcgccggcgcgggcggggcgagcggcgaccggccgcgcgggatcccggagggcaccacgccgctgtggagcgggccggacggctgggcgtatcgggacggcgccgcctccgtggtggtcgacgccaccggacagaacctgacggtcagcgtgaccaccgggtgcggcggtcagtagaccagggcctgcgccccctcggtcatgatctcctcgacgaacaccgcggccccggcgatccggatgccgggcagcacatcctggggagtgatcccacggcgcgccgcgcactgggtgcacgcggtgatccggcccgcctccagcagcaggtcgatcaggtcgggtaacggcgcggcgtgcggcaggacgaactccgcggcccggccgggcagggcgaaccaggtcgactccccggtcagccacagcgacacgccgaccccggcggtggcggccgtcgcggccacgttgaacgcctggttgcagcgctccggggcgtcggcgccggcggtggccttgacgaccagcaaacgtgccatagcggccagcataagatggtccggacatggttacggagatcgggttcgtgagcctgctggtcgccgggatgggcgcgctggcgggcggtttcggttatctggcgattcggatttcgagggggcgttggtgagcggcgagacggaaaacccactgggcccgccgccgtggctgaacgccccgccggtcgacgcctacccctacgaggacacgcacgacctgcgggtcggccccgacctgcacccgtcgctgctcggcctgctgccgttcatcggcctgtggcgggggcgcgggcagggcggcttcccggcggaggaggactacaacttcgcccaggagatcaggatcagtcacgacgggcgtgacttcctgcgcttcgagtcccggtcctggctgctcgacgacgactcgcagccgctcggccagtcgctcaccgagtccggcttctggcggccggtgctggtcgacgggcgccccggcgacgagatggaagccacgatgatccgcccggacggggtcgccgagctctacctcggcaaggcggccacgacgcggctggagatgggcaccgacgcggtggcctacacgccgtccgggttgcacgtgaccggcgggcaccggttgttcgggatcgtggagggggcgctgctctacgcgcacgagatctcgatcgacaacagcgcgctgacgccgcacatgtcggcgcggttgctgcgtatcggcggctgagatcttctgctgacgggaggcccggcgctgggcgtccgggcttcccgtcagcggtggtgccactccggtccggttgtccaggcgccagagggccgcttgctcaggccgtgctgaacaatcacgagcatggacatccccgacccactgcgccaggcggccgtcatggtcccgcggtgggctaccagcgaggccgggaccaccgtcgcggacgctgtcgactacctcgagcacaacgagtacgagatcgcgctcgacatcctcaccgaactgggcgatgcctacgccgccgatcaggcgttctggaacctcctggcagacgcggccacggagatgaacctgcaccgcgccacagcgtggtgtcactggagagcggcagaggctctccacggcatcatccgcgcggacctgcacctgttcggccctgagcagcctggtgcccgaaaggccgcgatacccggcgacggcatactgcgacccctgtggaatctcggattcgtcatgccggaaggtcatctcgacctgcacgccgcccgcatccgggtcgaaggggaaccccgactggaaccaggcgcatgcggatccatccgcctcgctccgctcgtccccgacagatggcggcacctgcgaccaggcgacgagatcaccatgcacgagcaggctccgccggccggaacggccaccatcacccagacgctgtttccagctcggtaacactcgcccgttcgcgctgtcggaggtctgtcgtccggtgggtcttgtcgccgggccgggttgcgtcggcaggaccgttgtcagggacccggccgtcccggcccggtcatgcggcggctcgctgacttgtcgaggctcgaccctgccctggctcagaagcccagcaactccagcaaccgcggcgtccaccgcgaccgctcccgcaccaccccgtcgaacgtcaccacctccgccagcccccgcagcgacgacgccaaccagatcgcgtccgccgccgccagctccggcagcgtcaccatccgctccaccccccgcagccccacctccccggccaccgacagcagatgcgccgccgtgatccccggcaggatcccggcctccgccgccggcaccgtgcacagctcgtcgcccgccagccagacgacggacgacgtcggggcctccatgacgtacccctcggtcgaaaccccgatcacgtcgtcggcctgatgccgcgccgcccagcgccgcgccgcgaaattggtcgcgtaggacagggatttggcggcggacagcgcccacggtggacggttcgtcacggagacgccgagcccggcgctgagcacccgcaccccgtcgcggcgttcccggaggacggtcgccgggatgtcggacacgctgacgtgcagcaggctgcgggtgtagatgatccgcagagcacccgtccgcccggcagaagacgagagatcgggacttggcggtacgggaaggtccagcagcgccgcggaccggcccagccggtccaggtgctcggccagcagccacgggccggacgggcgcaggtgcatcgtctcgaacaccccgtcgcccatcaggtcggccggggacaccaggatctgctcgctcatcaccgtgaaactagcgaactatgctcgtggggtgtccgccacttcgcttgccgccatgctgcgtgagcgcggcctgcggctcaccccgcagcgtcagctgattctggaagcggtgcacgagctcggtcacgcgacccccgagtcggtgcacaacgcggtccgtgagcgggtcgccggtgtcaacatcaccacggtgtatcggacgctcgagctgctggaagagctcggcctggtcagtcacacccacctctcgcacggatcgccgacctaccacccggcgggcgaggggcagcatgtgcatctggtctgccggtcgtgcgggtcgatcgaggaggtggagccgtcggtgctgtcgccggtctgtgatcgcctccgcgacgaacgtcacttccgggtcgatgtcgggcacgtctccctgttcggggtctgtggaaactgcaaggagtcggagtgaccgtggtcatggtcgaggatctcgacccgagttcggccgatgccggggtgccggcgcatttcggtgacccgatgaaggagcagcggctgctggagacgggggtcggcctggtcgaccggtcgcaccgggatgtgctcgcggtgccgggtccggagcgggccggctggttgcacacgctgaccacccagcacctgtccgagctgtccgcgaatcagggcagtgagctgctggtgctgtccccgcacgggcatgtggagcagcacgcgttcgtcaccgaggacggcaccacggcgtggctcgacaccgagccgggggccggcgcggggctgttgagatacctggagatgatgcggttcttcacccgggtggagccgcgcgacgcgacctcggagatcgccgtgctgtccctggtggggccggctgccgcggatctctttccggatctggcggagcctcgggtcggtgcggtgccgggtccgaagttcaccgccggcacggtgccggccgaggccaccgcgatctacgacgtacgcccgttcgagggcggcctggtgcgccgagtgcccctgggggtggatctgctggtgccccgccacgcgaagacgtcggtgatcgagaagctgggggtggcgcgggccgggctgtgggcctatgaggcgatccgggtcgccgcccgggtcccgcggctgcggcacgagacggaccaccggacgatcccggccgaggcggggttcatggccacggccgtgcacctggacaaggggtgttaccgcggccaggagacggtcgcccgggtgcaccatctgggccggccgccgcgccggctggcgctgctgcacctggacgggatcgccaccgatcacccgccggcgcaggggacgccggtggagctggacgggcgggcggtcggcttcgtcggcaccgcggtccggcatcacgagctgggtctggtggcgttggcggtgctgaaacgcaccgtggccgacgacgcccgcctcaccgtgggggagtcggcggcggcgatcgacgcctgagtcgccccgccatcagggcccgggcccggcagcgacggtgagtggtgagcgtggcgggcgcggctgcccgcgtccgcggaaatggggttgggcttttgttttccgcgccgtgggggcggtggcaggatgaccggcatgaccgggaccttgatcaccgtcgccccgaccggcgcggagagcagcaaggcggacgtgccggctctgccagtgaccctggacgagctggtgtcgaccgcgaaagagtgtgaggcgctgggcgcctcgatcatccatgtgcacatccgggacgcggatgcccggccgaccctggaccagggtcggctgcgcgccaccgtcgccgcgctgcgcgagtcgaccgggctgatcgtgcagctctcctcgggcggtgcggtgaccgacccggagacggaccggttggccgtgctcgatgccggcccggagatggcctcctgcacgatgggcaccgtcaacttcggtgacggcgtcttcctgaaccgctggtcgttcatcgtcgacctgcacacccgcatgcaggagcggggcatcgtgccggagtacgagatcttcgacctgggtcagctgaccaccctgcagcggctgctcggcaagtacgggctgccggccggcgggcacgtgcacctcgacctggtgatgggtgtgccgggcgggatgcccgggacggcggccgccctggtcgcctgcgagcaggcgatccgtgacctgccggccggcaccacgttctcggcgaccggaatcggtcgcggcacgatcccggtgatgctggcttcgctgtccgccggcgggcacctgcgggtcggcatggaggacacgatcacgtacgccaagggccgcccggtcgagtccaacatgcagctggtcgcccgcgcggtcggcttcgcgcagctcgcccagcgcccgccgctgaccccggcgcaggcccgcgagctgctcggggtgccggcccggtgaccgtggtcgcggaggtggtccgctccggcttcgtggagagcgtgcaccacggcatcgtcgcgttcgccgaccgccccggcgtcggggacaccaccggcccgttcttcccgcggtcgtcgaacaagccgctgcagaccgtcggcatgctgcgcagtggtctggtgccgcgcgaggagaccgacctcgcgatgatcagtgccagtcacgacggcgagccgtttcacgtggatcgggtgctcggcatcctggccgcggccggtctggacccggcggcgctgggctgcccggcgcagctgccgatgggcgagccggcccgggaggcctggctgcgcggtggtggcgacccggagcggatcctgatgaactgctccggcaagcacgccgggatgctcgccacctgtgtcgtcaacggctggccgctggattcgtacctcgatccgaagcaccccctgcaggtggcgttcgccgccgcggtcagcgacctgaccggcgagccgatcgcggcgaccggggtggacggctgtggcgcgccggtcctggcggtctccccgcaggcgctggcccgctcgttccagcggctggtcgaggcggcgccgggcaccccggagcgccgggtcgcggacgccatgcgcgcgcatcccgagctggtggccgggaccggctcgccggacaccgtgctgatggccgcggtgcccgggctgctgatgaagagtggcgcggacggcgtggtggcggccgcggtgccgggcgccggcgcggtgaccgtgaagatcgccgacggctcggcccgggcgcgcgtcccggtgctgctggcggcgctgcgccggctgggtgtcgagccgccggagctggccgagccggtgctcggcggcggcgtgccggtcggcgaggtccgctcggtctggtgacccgtctcacgctagctcctgcaagcgttctgcttgcaggagctagcactgcgcgctaacttcgagtcatggccacttccaaggacctgccgcaggacatcgggacgttcatccgtgacctgcggcagaccgcgaagatctcgctgcggcagctcgccgacaaggccggggtgagcaacccctacctcagccagatcgagcgtggcctgcgcaagccgagcgccgaggtgctgcagcagatcgccagcgccttgcgtgtgtcgacgcccgcgatgtatttgcgggccggactgctcgatggcgagggtcagcagggtgtgctggcggccatcgcggtcgacccggagctcacgatcgcgcagaagcagtccctgtcgcagatctacgagacgttccgcaacgagaacgctcgcaacgcggctcccgccgagtccgcgcccccgacagaccctgccgaggagacgaaatgaccgagcagaccaagaccaggatcccgaccccgctgtacgccgccgccggtgccggtgacctcgcgtaccagcagcttcgcaagctccccacggtgctcaccgagctgagcgaccgggccgtcgcctcgctgcgcaccgccaacgagcaggccgccgagctgcagaagaaggcgtccggcaccgacttcgccgcgctgcgcaccaacgccaccacggtggccaccacgttcgcccaggtcgcccaggagcgggccgtcgcggcgtacaccgcgctcgtcgcccgtggcgagaaggtcgtcggcaccggcatcatcgagtccgccgaggtggtcaacgccgacatcgaggccaccgagcagccgaaggccgtcgaggccgccgtgcagcaggcgcaggccgtcgagtccgccgagacgccgaagccgcgcaagcgcgccaaggccaccccggcgccgaaggccgccgagtaaggatcgcgacatgatccgcgggccccggcattgccggggcccgcggcatagactgcccggcatgggctcttccgcgccgctgttcatctacgacgtccagttctggaccgagacggtcattctcatcctggccctgctcctggagctggtggccttcgtccactgcctcacccagcggggcgcggcattccaggcgctcggcaccctgcccaagggggcgtgggcggccatcatcggggtgtgcggcctgttcacctggtggggtcagggtgcgctgggcatcttcgggctgatcgggatcgcggccgcgctgatctatctgctcgacgtgcggcccgggctgagggacatcgccgacggcaagggtttctggtgagggtcgccgcgtgaggggacgcttcgggccgcctccgccggacggcgggccacgcctgcagcgcggcgatcggaccgggccgcgctccgggcggcctacgctgccgggtcccgagaccgagctggtcaccctcgacccgggcgtacgccgaccgtccccgcgcccgcccgcacccgtgcacggttcctcgccgctgcgcctcgagcagctcgtcaccggcctcggcgaccccgtgacggtgttcgcgcacggactggccggggacatctccggcacccgcccgctgggcagcgcggtgaccggccgccgggtgttcttccacttccgcgggcacggccgctccgacgccccacccggaccgtggagcttcggcgacctggccggcgacctgcgcggggtggccgacctggccggcgcgacccgcgcggtcggcgtcagcatgggcgccggcgcgctgtgccgcctgctcgccgagaccccggaccggttcgagcggatcgtgctctatctgcccgccccgctcgacggcagccgaccggaggccgcgctgcgccgcctcgaccgtctgctcgcctcggtcgagtcgggtgaggccgcgatgatcgccgacgcggtcgaggcggagatcccggcggcggtgcgcaacaccccggccgggtggggcttcctgcgtcagcgggtcgaccagctgcagcgcgacgggctggcggccgagctgtcgacgctctggtcggcgccgccgctgccggacgagtcgctgctcaaggccttccgggggcgggccctggtgatcggctgccagggcgacgagatccacccggtggccggtgcggagcgggtagccgggctgctcgacgccgacctgcacgtctatgaccggccgtcgatcctgtggaccgaccgggcggacctccgtgagcggatctcggcgttcctgaacgcttgaccgccgcgccgcgccgcgccgcgccgcgtcgcgtcgcgtcgtgccgcgctgcgtcgtgccgcgctgcgccgtgccgcgctgcgccgtgccgcgccgttccgggccagacgccggggcgccggacggcgtgccgttatgtccggaaaccgtaacttttccggtccggcggcgatgtttctgacgtgcgcttgtcccctaaatccgtttttatcggcgttctggcgatcggcctgcccttcgccgtcgtggtgggctgggccctgggcaccccggtcacccagactacggccgccccgggaaccggcggtgccggcggcagcgacggcctcggccgggccccgtcccgtccgcactacgcgtccggcggctacggcaaccacccggccgcaccggccggcgccgcgtccccgaccaccgcggccagcaccgtgatcaccaagacggtcatcgtgcccgcctccgccgcgcccgcgaccgccccggccacctcaccgccgccggtcctcaacgaaccgccggtgccgacacccaccacgatcaccgggccgcccgagccgatgccgtccgacagcgcctccgcgagtgcggccatcccggcgcccagcgcctcctgacgcgcggcgcccgctgcctgccggtcgcggccggcgttgcttcgagtggcggacgggacaggcacgactaagctcccggatcgtgaaggaagatccgaatcggccggtggccgcggttcgtcagttcgtcaccggcgccggcctgctcgggcgcgggctcggcctcgtcctgcgcagcccccggatgctgggcctgggtctgctcccggcgctgatctccggcgtcgtctacaccatcgggctggtcgtgctggtccgcttcctgccgcagctctccgagcatgccacctggttcgccgcacactggtccggcttctggcgcgacttcgtcgaggtgctggccggcgccggcctgctcggcctggcgctgctgctcggcgtactcaccttcaccgcggtcaccctgctgatcggcgatccgttctacgagcgcatctccgaactggtggagaatcggtacggcggcgtgccggacgccgtcgacgtcggcttctggagctcgctgcgccgcagcctcgccgactcggtccggctgatcggactctccgtcctcgccgggataccgctgttcctgctcggcttcctgccggtcgtcggccagacggtgatcccggtcctggccggcgcggtcggcggctggctgctcgccctcgaactcaccggcgtcccgttccagcgccgcggccagcgtctgcggcaccgccgggtcgccctcgccaagaacgtcccgctcaccctcggcttcggcgccgccgtgttcggcgccttcctcatcccgctcggcgcgatcttcctgatgcccgccgccatcgccggcgccaccctgctctcccggcgggtcctgggccgccccatcgacatcaccacggtcggctccctgtgatgcggatcgagctcgtcgagggcgacatcaccacgcggcaggtcgacgcgatcgtcaacgcggccaactcgtcactgctcggcggcggcggggtggacggcgcgatccaccgcaggggcggcccggagatcctcgccgagacgcgggcgctgcgggccgcccgatacggccgggggctcccggtcggccaggccgtcgcgaccaccgcgggccggctgccggcgcgctgggtggtgcacaccgtgggtccggtgttcagcgccaccgaggaccgctccgagctgctgcgcgcctgctacacgaacgcgctgcgggtcgccgacgaactgggcgcggaaacggtcgcgttcccgctgatctccgcaggcgtgtaccggtggccggtcgacgacgcggtccggcaggcgctgaccgccctgcggtccgcccgaccggagcgggtgaccacggcgtacctggtgctgttcggcgccggcaccgccgcgaccgcccgcgccgtcgccgagggctccgccgagctctgactcggggacggaacccggccggcggtcaggccgagtcgcggacgatcagctccgtcggcagcaccaccgagttcggcacgtcctgctcaccggcgatcagcagcagcatctgccgcgccagggtctgcccgatctcgccgatcggctgccgcaccgtggtcagcggcgggtcgctgtaccggctgatgtcgaagtcgtcgaagccgatcaccgccacgtcggccggcacccggcggccggcttcgcgcagcgcggtcagggcaccgtgggccatcaggtcgctggccacgaagaccgcgtcgagctcggggtcgcgggcgaggagctcgcgcatcccggtgatgcccgattcgcgggtgaagtcgccggtgaccgcgagttccggcagcccggccgcctgcagggtggcgtggtagccggcgaggcgttcgatgccggccaccatgtcctgcgggccggcgatggtggcgatccgccgccgcccggtccggatcaggtggtggacggcggccgcgacgccgccggcgtggtcgacgtcgacgtaggggacggcggggtcgctgccggcggtcatcgggcggccgctgcagatgaccgggatgccgcggcgggcgagggcgccggggagcgggtcggcgccgtggatgctggcgaacatgacgccgtcgacgtggccggcgaccgcgtacctctcgacgcggtggtggccggcttcggagccggtcatcatgaggacgagctgtttgtcggcggcttcgagttccatgccgacgccgcggatgatcgcggggaagaacaggtcgtcggagaagacccggttcgcggtttccggcaggatcagggcgaccgagtcggtgcgctgggtgaccaggctgcgggccgcctggttgggcacgtagccgagttcgtcgacggcccggttgaccgcctcccggatggtggcggccaccgtggtggacccgttgacgacgcgggagacggttgcccgggacaccccggcgcgccgggccaccgcctccagcgtgggccgctcccgcgtcgtcacaaaccgctccttaggaaagcccgttgcgcttgatcacctcgcggtaccacttcgcgctgtctttgagcacccgctgctgcgtcgtgtagtcgacgtgcacaataccgaaacgcttcgcgtatccctcggcccattcgaagttgtccatcagtgaccagaggaagtatccccgcagatcgactccggcggccagtgcgtcgtggcaggcgcgcaggtggccgtcgacgtactcgatccggcgccggtccggaacggtgccgtccgcgatcgggccctcggggaacgccgcgccgttctcggtgatcatcagcggggtgcccgggtagtcccggtggatgcgggtgagcagccgggtgaggctggccggctcgatcggccagttcatgtcggtgaccgggccgaccggcgggcggaaggcgatgccttcgctgcccgggtagtccttggcgccgggcgcgccgggcttggccgacacgtacgccgggttgtagaagttgatgcccagcacgtcgagcggctgctggatggtggccaggtcaccgtcgcgcaggtaggagaggtcggtgagccgggcgatgtgctccaggacgtcggccgggtactcgccgcgcagcagcgggtcgaagaagatccggttggcgaggccgtcgatgaggtgggccgcggcgcggtcggccgggctttccgggtcgaccgggtagacctcgcacgggttgagcgtgatgctgacccgctgggcgccggcggcccgcagcgcctgcgccgccaggccgtgtccgaggagcaggtggtggacggcggccagggctttggccgggtcctgcacgccgggggcgtggatgccggagccgtagccgaggtaggccgagcaccacggttcgttgagggtggtccaggtgccgacccggtcgccgagtttgcggtagacgacctcggcgtactcgccgaacgcctcggcggtctcccggtcggcccagccgccgcggtcctccagcgtctgcggcaggtcccagtggtagagggtgacgaccgggtcgatgcccttgccgagcagttcgtcggtgagccggtcgtagaagtcgaggcctcgggcgttgaccgggccggtgccgtccgggcggacccgcggccaggcgaccgagaaccggtacgaggccaggccgaggtcggccatcagggccacgtcctcgacgtaccggtggtagtggtcgcacgcgacgtcgccggtgtgccccttgtgcactttgccgggtgttcggctgaaggtgtcccagatggacgggccgcgaccgtcctcccgcgccgcgccctcgatctggtacgaggccgtggccgcgccccagatgaagccgtcggggaaggtgatccccgcacgcgccggctgcgccgacgtggacgtgacggttgccgtcatgtcttcaccgcttccttgatccgctgaacttaaccggttcatcatagggcccgacctccccacagcggcgtcgtccaacggtgcgggaactcagccggtgcgaagagcctggatcaggcggggatcaccgctcaacgccaattggtcggtacgtttgcggcccatcagtgccaactgcagatcactggccgtgccggtcgccttggcccgggcgtggtgatcgtcggtgtcgaggatcgtgccggtgtccagcagcgcgatccccgccccgcgcagccggacgaaccactcggtttccgcatccgtgccgaccaggtgcaccacgccgtgcaggtcggtcggcccctgccgtttgccggccggcagccaggtgtcgaggatctcggccaccccgtcggtggccagcttggtctcgatcggggtgggccgcccggccgccgcctcggcgtcccagcggtgcaccgagatctcgtgtgccatccgccggtcccagaacaccgcccgtttcggctgcggcgcccagttccacgcgggcagatccgggtcgagcgcctccagcgtctcgatcgtcccggtcagctcgcgccggagctggtcgagggcctcgtcccactccggccgggaatcggagcccgggggagcggaggggcggtcggtgaccccgcgggcgatcgtcgcccgcacccagcgcagcaggtccagaacgtggaacgccaggtcggcggtggtccagtcggggatggcggggaccggcacgccgggaccggtctcggcgacggcctcccacagggccggcccgtcggcgcgcagcgccgccagccagaaatccttcgtcgcgtgcaacctgttcatcgcagtcgtctcccgctcggccgggccgcaggtttttcactccgccccttgagcttagggtgaaccccgtgcccgacgcattcgccgaccacctgactgacccgacgcccgccgcggaccgagtgctggcggcctatacgacgctacgcctcggcggcccggccggcacggtgaccaccgcggtcgagacggacgaagcggtcgccacggtgcgtaaagccactgccgagggacgtccggtcctggtcctggccggcggcagcaacgtggtgatcggtgacgccggcttcgccggggaggtgctgttgctgcgcacccgcgggatcgaggtggtctcggagagcgccggcgaggcggtggtccgggtcgccgccggcgagccctgggacgatttcgtggcgtacgcggtgggcaacggcctgtccggcgtcgagtgcctgtccggtatcccggggtcggccggcgccaccccgatccagaacgtcggggcgtacggccaggaggtggcgcacaccatcgtggcggtgcacgcctacgaccgggtcgccgacgagcagctgatgatgtccccggccgactgcgccttcggctaccgctccagcgtgttcaagcacaacgaccgctacctggtgaccgccgtggacttccggctggcccgggcggatcgcagtgccccgatccggtacgcggagctggcccgtcagctgggtgtcgaggccggcgaccgggtgccgctggagcacgcccggcagaccgtgctgaagttgcgggccggcaagggcatggtcctcgacccggcggaccgggacacctggtcggtcggttcgttcttcaccaatccggtggtgagcgccgcgttcttcgccgagctgaccgcggcgcgtggcgagatgccgcactggccgggcgcggacggcacggtgaaggtgccggccgcctggctgatcgagcacgccggcttcccgaaggggttcgccggcgccggggtggccatctccaccaagcacaccctggcgctgacccatcggggcgccggcgacaccggtgcgctgctggatctggcgcggaccatccgggacggggtgcgtgaccgattcggcatcacgttgcaccccgagccggtgctggtcaactgcgcactgtaaaccggttcagctccacccgaaggtctgggtgtagtacggcgtcccgtccgccgcgtacacgatggcggcgccgatcgacttcgctccgcagttgaggatgttcgcccggtgtccgggactgttcatccacgcctgcatcacctcggcggcggtcgggtagccccaggcgatgttctcgccggccggggcgcggtatccggcccgttcggcgcgcatcgcgaaggtggagccgtcccgccacacgtggctgaacagccgggtccgcgccatgtagtagctctgcgccaccgaggccacgatcagctcgtggtcgaccgtgaggcgggcgcacccgttcgcctcccgctcccggttggtcaggcggatcacctggtgcatcagggtgcgggcgcgggccttcaccgggtcgaccgccggcgccgcggcgatctgcggggtgatcggcgcggccgggatgacggtcgaggtcgccggatcgggtgaccccaaccgttccggggcgggggtgggcatgcccggcggccggggcgggaccaccgggccctgggcgtgcacggcgtgcggcagggcgaacagggcgaccggcagggcgagcagtgcgggcgcggccgcgagcgcggaggcgcggcgtaccaccttgtcgaacacgggtttcctcccatatccgtggtggacgcgattcgtccaccagggatatcggacccttaacttcgccgcgtgtcacatctttcgcggtatggcggaaatgtcgtactggaaatgaaatcctggggggatgggcgagccgccgccggctcgcggaccgtgcccgtcatcggcccggagatccttggggaccagcccgtgtaccgggcctttgcccgctaaactgtcactgtccgtaaataggcagtgacatcacgctatggtgtctttgcgcctttgaatatctcccgcccgcggtcgcgcggacggtgccaagcaggacaaccgacttcccggcgccatgcgcccggggatcggccgtgcccggaatcgggcgcgagcacgagctgggggcagggtgagcacacgatgagtcgcctactcgtggtcgaggacgacccggacatcgcactcgccctgcggctgctgttcagccgggccgggtacgaggtggcccacgccgcggacggccgttccgggctgaaggaggcctacgccgagcaccccgatctggtggtgctcgacgtcggactgccggagatggacggctggcaggtgctggagcggctgcgggacgtgtccgacgtgccggtgctggtgctgaccgcgcacggccaggaggccgagaaggtgcgcggcctgcgcggcggcgccgacgactacctgaccaagccgttcgccaacaacgagctgctggcccgggtggaggcgctgctgcgccgctcgtcgagcggacagaacagctgggccagccagatctacgacgacggcctggtgcacctggacccgaccaagcgccgggtctatgtcaaaggcgacgagaagcggctcacgccgaccgagttccgtctgctcaacgcgctggtccggcatgccggagcggtgctttcgccgaaccagctgctgacccaggcctgggacgacccgaccggcatcggccaggagcgggtcaagttcgcggtcctgcggttgcggcgcaagctcggctggtccgacccggacgaatcgccgatcgaatcggtgcgcgggttcggctatcgctatcgacgtccgggcggagaggcctgatccaggccgtatcggacgagtcttctcagttggcgcccgcgagggtcgatgagggctgtgaagccgagcaggaggtagacgtggaagaccttggcgagatcgtcggcgaattcctcatggagtcgcacgagaacctggaccagatcgaccgggacctcgtgagcctcgagcaggagccggggtcacgtgacctgatctcccgcatcttccgggcgatccacacgatcaagggcacgagcgggttcctcgccttctcccgactggagaagctcgcccacgcgggtgagtcgctgctctcccggttgcgcgacggcgtccagccggtcaccccggagaccatcaccgtcctgctgctctgcatcgacggcgtccgctcgctgctctcctcgatcgaggagaagggcaccgaggacgaggtcgacatcgacagcatgatcgtccggatcaaggcgcagatggacgcgccgaccgacggcgccccggcggccgcactagctagctagaccgaggcgcccgccgcgtcgcgcccggctcccgagccggtcgccgagcagcggcagccgatcgggcagatcctggtcgaggccggcgcggcccaggccgccgacgtcacctcggcgctgcagcagcagatcgagggcgacgaacgcaagctcggcacgatcctgctcgaggagggcaagacgcagccggccgcggtcagcgaggcgctgcagtcgcaggccccgaagcggagcatcgcggacagcgccatccgggtcgacgtcgacctgctggacaccctgatgaacatggtcggcgagctggttctggcccgtaaccagctggtccgcggcgtgatggagatcggcgactccggcctggtgcgcagcgcccagcggctcggcatgatcaccagtgagctgcaagagggcatcatgaagacccggatgcagcccatcgagcacatctggtccaagctgccccgggtcatccgggacctgagcaactcgctcggcaagcaggtccagctggtgatggagggcaaggagaccgagctcgaccgcagtctgctggaagcggtcaaggacccgctgacccacctggtgcgcaacgcggtcgaccacggcatcgaggacccggagcgacggctcgccgccggcaagggtccggagggcacgttgaccctgcgcgcctaccacgagggtgggcacgtcgcggtcgaggtcgcggacgacggggccgggctgaacgtcgagcggatcgcgcagaaggccgtggagaacgggctgctccggccggagcaggtaccgaacatggacaagcgcgacatcatggcgatggtcttccagcccgggttctccaccgccgccaaggtcaccaacgtctccggccgcggtgtcggcatggacgtggtgaagaccaacatcgagaacatcggcggcgcggtcagcgtcgactcgacgcccggcgagggcaccgtctggcgcctgaccatcccgctgacgctcgccatcatccaggcgctcaccgtcgactgcggcgaccagcggtacgtggtgccgcaggtcgcggtcctcgaactggtcttcgtcgacgggcagaccaccaaggtggagtacgcctcgggtgccccggtgtaccgcctgcgcggcaagctgctgccactggtccggctggaccgcgcgctcggtctcgaagtcggtggcgaccagggcgtctacatcatggtgctgcaggccgacggccggcggttcggcctggtcgtggaccgggtgctgaacaccgaggaggtcgtggtcaaggccctgaacaccaggttcaaggacatcggcctctacgccggggccaccatcctgggcgacggcaaggtcggcctgatcctggacgtgtcctcgctggcccgccgctcccacctggccgtcgactcggagcgcgagaacgtcgccgagaagcgcggcccggccggtggtggcaccgagcgcctgctggtcaccgcggtcggcgagcgccgggtggcgatcccgttggacacggtcacccggctggaggagttcccgcgcgaccggatcgagcacgccggctcccgcgaggtggtccagtaccgcggccagatccttccgctcgtgcgcctgtcgcacctgctcggggcgtacggcgaggagttggagggcgacaccgtctcggtggtcgtctacagcgagggcggacggagcgtggcgctggtggtcgaccggatcgtggacatcgccgagaactcgacgacggcccgtcgggaggccgaggaggacggtctggtcggcaccgcggtgatccagcaacgggtcaccgagctgctcgacgtgcgccgggcgatcctcgccgccgaccccaacttctacagcgacgcgtccgacgagatgttggtggaggcctgagatggcgagtcgccagttcgccaccttcgaggtggacgggcagctcttcggggtggaggtgcataccgtgcaggaggtgctctcgtacaacgagtacaccccggtgccgctcgcaccacccgccgtcggcggcctgttcaacctgcgcggtcaggtgatcgccgcggtcgacctgcgggtccagctggggcttgcccggcaggccctgcagggcccggtgatgaacgtgatcctgcgcggcgacggggagccggtgagcctgctggtggacaagatcggcgaggtggtcgacctggacgaggagaccttcgaacccccgcccgacacgctcagtggtcccacccgcgagctggtggtgggtaccttcaaactcgacgggcggctcatgctggcgctcgacgtcaatcaggcggtcgatacgtaccgcgccacgaactgatgtacagcctggtcagcgcccccgtcctgggcttcgacctgacccgcctgccgggcgggtcggcggcggccgacgtcctgctgcgcggtctgcgcctccaggccgccgacctgccggtgctcgccgagcggctcccggacgagggtgtccggggtccgctctgggtcgaggtggagagcgccgcgcgccggatgccgaacctcaagggcatgtcgaaggacgacccggcgggcaacctggccctggtcgagcgggcgccgatcggctcggtggacgcgctgctgacctgcctgcgctacgacgtgatgtcgtggacctgggaggggaccggccgggacgcgcggcagaccgaggaggcggccgcggccaccgcgctgctctgcgacgccgcggtcgggtgctacctgcgggaggtgctcgacgacgacgcccgacggcgactcggggccggctgggtggcggccatgaagaaggtgccggcgggcgcgccgatcgacctgggaccgcaccactacaccgtctccgccctgttggacaagctgcgcacgctgcggccggaggaccgaacccgggtcgtgaccgccgccgacgacgcccggcgcaacaccgccggctggtcgccggccgtgcactcggcgtcctgggctgcgtacctctccgatcgggtccgcaccgcggccgcggcgcagatgctgttggtgcaggcggtggacacggccgggattccgctggccgaccgggccggcggggtctggaacatgctcagcggcgccgtccaggcgctggtggttcgcgatctgctggacaccgcaacggcgcaccggctgctcgcgccggtcgtcgcggcactcggtccggcctggctcggttgaagggagtggtcgaatgatctcggttctcgtcgtcgacgattccgtggtggtccgtcggctgatcgtcgacgctctcggggaggcgccgggcattcaggtggtcggcaccgcggcgaacggcctactggcacaggccaagatcgaccagctcaaacccgacgtggtcaccatggacatcgagatgccgcagatggacggcatcgaggcggtgcgtgaactccgcaaacggcacgccgcgctgccggtgatcatgttcagcacgctgtccgcggcgggcgccaccgccaccctggaggcgctctccgcgggtgccaccgactacgtgaccaagcccagcaacgtgggctcggtgaaggaatcgatcgaggcggtacgcgaacagctcgtacccaagatccaggcgctcggtgggcgccgtcgcccgccgcccggcgcgccgccgcgactagctagctagcgccgtggcccgcagggccggatcgacatcctggcgatcggctcgtccaccggcggcccggacgcgctgaccaaggtgctgcacgggttgccggccgacctcccggtcccggtggtgatcacccagcacatgccgccggtcttcaccaagatgttcgccgaacggctggaccgcagcatcccgttgaaggtggtcgaggccggcgacggcatggaactggcgcccggcacggtctacatcgcgccgggcgaccggcacctgatcttcaaccgccggggcacgtcgacgctgacccagctcagcaacgcaccacaggagaactcctgccggcccgccgtggacgtgatgttccggtcggtggccgcgctgtacggcggcaccgcgttcgccacggtgcttactggaatgggacaagacggacgaggtggtgcgaaggtgctgcgagacgcgggctgtgagattctggcccaggacgaggcgtcctcggtggtgtggggcatgccgggcgccgtggtcggcgcgggtctggccgatgaggtgttgcctctcgaccggatcgcggcggcgctgctgaaccgggtgcgggtgggacggtccgcggcggtggcccgatgaccctgtcccaggccgagttcaccttcgtcgccaacctggtgcgccgggaggcctccatcgtgctggcgcccggcaaggaatacctggtcgaggcccggctgatcccggttgcccgggtagtgggcgcgccaaacgtcaacgatttcatcgccgatctgcagaagcgcccgaacccgcagcatcagcggaagatcatcgacgcgctcaccaccaacgagacctccttcttccgggaccgggagccgttcagcgcgctcaccgacgtggtgctgccggagttggtcaagtcccgggccagtacccgcaagctgcggttctggtcagcggccagctccagcggccaggaggcgtacagcctggcgatcacgctgcaggagtcgctgccggccggctggtcgttcgagatccagggcaccgacatctccaccgcgatggtcgagcgggcgcagaaggcggagtacagccaggtcgaggtgaaccggggactgccggccacccagctggtgcagtacttcgagcgggccggcgcgcactggcgggtgatcccggcgctgcgccgcaacgtctcgttcaagcacatgagcctgaccgcgccgttcccgccgatgcagccgttcgacgtgatcttcctgcgcaatgtcctgatctatttcgacgtcgccaccaagcgacaggtgctgcagaacgccgccaagatcctgcgccccgacggctggctgttcctcggcgcggccgagacgacgatcgggatcgacgacaactatgagcgggtggccgccggccgcacatccgcgtaccgaatccgcaatgcggtgcccgcgggcgccgggagaaggggatgacgccgatgcgcgccatggtgatcgatgactcgcgcgcgatgcgcatgatcctcaagcgcatcgtcacgaagctgagcttcgaggcggtcgaggccggcgacggcaaggaggcgctcgacctgctcgccgatatgaccgaggtgccggaactggccctcatcgactggaacatgcccaacatgaacgggctcgagttcgtcatgaaggtccgggccgacccgcggctgcgcgagatgaccctggtgatggtcaccaccgagagcgaacagagtcagatcgtccgagcgctcgccgcgggtgctcatgaatacgtcatcaagcccttcacggagggtgccatgatcgaaaaactggccctgctgggcctcgtgccgaccggagcgaactcatgagcgtcgaagtcgacgtagacgagaacgacctcgctgagatggtggaacaggtctgggagtcgtacctggatccggagggcgtgagcccgctgatgcagacgtacgacgagaaccagccctcggaagtgcactcctcagtgtcgatcaccgggtcctggaccgggcacatcgtgtacgcgtcctcccgggccgccgcccagcgggccgcggccgccttcctggccatggaactggacgaggtgagcgaggaggacatctccgacacgctcggcgaactggcgaacatcgtcggcggcaacgtcaaggcgatgcttccgccgggttcgcagttgtcgctacctcaggtagtgctcgcgccggagagctcggcgcgttatccgaacaccgaacgcatcagcggcgtctatggactctgggaaggcgagccggtgtccatttcgatgtggcagagcagcaccgacacgaaggaggagggtgcatgaagatcctcatcgccgatgacagccgggtgatgcggcagatcgtcgtccgtaccctgcggcaggccgggttcggcgaccacgacctgatcgaggccgcggacgggcaggaggcgttcgacatggccagcaagcagcagccggatctggtcatctcggactggaacatgccgcagatgaccggcatcgaggtgctgcggcaactccgggcggccggcaacaacgtcaagttcggcttcgtcacctcggagtgcacgcccgagatgaagacggccgccgaatccgcgggttcggccttcttcatcgtcaaaccgttcacggctgagcgattcgacgaagtcttcgctccaattttgggatgattgcgacatgtcagacgtctcggtacttcccggctctctagccgtacgcaatctgttcgaggatctcctcggccgcgaggtcaccgtcagccccggtgacccgctcagcgcggacgagatccggaccgccacggtcgcgatcttcaccgacaacagccagaagatctacgcggccatgggcctgcagctgagcctggcggccaacgccggcgccgcgctcggcctgctgcccccgggcgccgccgaggacagcatcgacgagaagcagctcttcccgaacctggcggagaacgtcggcgagctgtgcaacatcttcaccagcctgctcaacaaggagggggccccgcacaccaagctctaccaggtgatctacccggggatggagctgccggccgacgcccgcgcgatcctgctcgcgctcgggcggcgcctggacctgatggtcgaggtgagccggtacggcaagggcaagatgagcctgtcgctggcgccctgagcgcccgggtatggcgtacaccattgaagaactgaaagatgcgggcccgccggcttccggcgggcccgcaaatttgtggctaagcaattcctggtccgggccgaagcttaggttgagcttgccaagggacaggagaagtcaatgacctcgccgacctctggaatgggcgccaccggcgcctcttcggacgccgcacaggccgccgccgcgctcaaggctgaggccgcgaagcggcaggccaaggacaaggacctgggggacaaggacaccttcatgaaactgttggtggcccagctcaagtaccaggacccgtccaaacccgccgactcgacccagtttctcgcccagaccgcgcagttcacccaggtcgagaagctggaagacatgatcggcatgatgaagtcgcagcggatgacgagcgccagcatgctggtcggcaagaccgtcacgtacatggacgccaacggccagtcgcagaccggcgtggtgtccgcggcgaagctcaacggggacagcgacccgaccctcaaggtcggtaacacggatgtggacctgtccaaggtcacggagattcagcagaccgcctgaaaaagaccgcccgcttcttgagcccttttctcgaccttaaggacgatctttaatgctgcgttctctctactccggcatcagtggcctgcacgcgcaccagcagatgatggacgtcaccggcaacaacattgcgaacgtcaacaccgtcggctacaagtcggaggcggtgcagttccaggacacgctcagccagatggtgggcgcggccggctcgccgcagaacggcatgggcggcaccaacccgtcccaggtcggcctcggtgtcaaggtcgccggcatcagcaagaacttcagccagggctcggccgagaccaccggcaagtccggcgacatgatgatccagggcgacggcttcttcatcacccggaccggcaacgagcagatgtacacccgggccggctcgttcttcttcgacgccaacggcacgctggtcaccaccagcggccagccggtgcagggctggaccgcggtcgacggcaaggtcaacgccggcggccagccgagtgacatcaagatgccactgggtgccaccatcccgcccgcggcgaccacccagatcaccctcaagggcaacctgaccagcgacttcccggagaacaagctggccaccgaggacaccgtgacgatcccggtcaaggtcttcgacaaggacggcgcgacccacacggtgaccgccaagttcacccgggccatcgacccgaaccgggtcgccggggacaccccggacaccacctgggacatcgcgctgtacggcgaggacggcaccgccatctccggcgcgaccggggagatcgacatgaccagcggcaaggcgatcgtcagcgccaccgacaccccggccaccggggagttggacaaggacggcaacatgcagatcggcgattacaaggtcaacatggccgacctgaccatgtactccgggctgtcggacgctcgggtgttctccaccgacgggcagaccgccggcgcgctgacctcgctcgcatacaccgtctcggacaccggtgagatcgtcggcgtgtacagcaacggcttgaaggagacgctgggccaggtcgccatggccaccttcaagaaccccgacggtctggagaaggtcggcaactcgaccttccgcagcaccgtcaactccgggtacgcccaggtcggtcagcccggcagcgccggcatgggccaggtgatcagtggcgccctggagatgtcgaacgtcgacctcgcccaggagttcaccaacctcgtggtggcccagcgtggcttccaggcgaactcgaagatcatcacgacctccgacgagttgctccaggaactcgtcagcatgaagcgctaacgggtagcggcaggagtctcggcggcggccggggcaggcgtggagcctgtcccggccgccgccttttgtgcaggcgtcgcgtgtcggacgtcgcacccggatagcgaccggctcgatctcatcggcaaccgaggtcgggccgaagtactaggcgtagggccacggacggcccgacaccagcccaggacgacccaaggacggaacagtcttgatcctcgtaactcgaatcaacggtgccgtgttcgcgctgaacccggacctggtcgagcgtgtggactgcacgcctgacacggtcgtcaccctggtggacggcaccaagtacgtcattgccgagtccgtgcccgaattcatcgactcggtgcgtcactaccgcgcctcgctgatcgcccaggcgagtcgtatggagcctgagcccacggccgccctctcctcgtctgacgacgagctcgacgccaaggtgctcccgctgcaccggaaggaccgctaatggacatctcaaccgtcgtcggggtgctcgccggactggcgatcgtcttcaccgtccagatcctggacggtggctcgcccagctccatcctgctgatcccctcgatgctgctggtcttcggcggcgccttcgcggcggccatggccggcggtgtgttcaaggacgtgaccgggttcggcaagcagctgcagaaggccttcaccgccaaggtgacgccgccgacccagctgctcgacaacgtggtcaagctggctgagcgggcccgtcgcgagggtctgctggccctcgaggacgcggtcaagacggtcgagcacccgttcctgaagcgcggtctgcagctggccatcgacggcaccgacccggacgagctgcacgacatcctgcacgccgaggtcgcggccaagaagaaggcggacaaggccggcaagaagttcttcgagaacatgggcggctacgcgccgaccatcggcatcatcggcacggtcatgggcctggtgcacgtgctggagaacctcgacaagccgaccacgctgggcccggccatctcctcggcgttcgtcgccaccctctggggtgtgctcagcgccaacatcatctggctgccgatggcggcccggctcgaccggctcagcgccgtcgagtccgaggagatggagctggtgatcgacggtgtgctggcgatccaggccggctccaacccgcgcctggtcgcccagaagctgcggagcctgctcccgccggacgagatgaagaaggctgaggccgcggcctcctcgaagaaggcggcctgacccgatgagttccggtggcggcggcgccaagcgcaagaagaaggcccatgaggagcacgaggagcacgtcaaccacgagcgctggctcgtgtcgtacgccgacatgctcaccctgctgttcgtcctcttcgttgtcctgttctccatgagtgacatcaaccagaagaagttcgcccagctcgcgcagggtctctcggcaagcttcggctccaagagcgccgcgttcaccggtaactacgccccgctggacggctcggcgaacaacgcgcaggtcgtgcagatcgacccgggcgccaacccgggtgacgggtcctcgggtaccgagggcctgaaccagaagcagcaggaggccgtctcccgggcggtcatggcggaggaccgcaagaaggcctcggccaacgcggacaaggcggcgaaggaggcggagaacatgaaggcgatcgagaacaagatctccgacgcgctcgccgcggccaagctgctggacaacgtgaagttcacgatcgaccagcgcggcctggtcgtcacggtggtgaccaacgaggtggtcttcgccggtgaccgggcggacctgcgcccgaccggcgagaagatcctcggcgcgatcgccccgacgctggcgaagctgccgaacaacgtcgaggtggacggcaacaccaaccagctcaacgcgaagaccaggtactacccgagcggctgggagctgtccgcggcgcgggcctccaccacggtccggtacttcaccgggcacgggatcgcgaagaagcggctcagcgcggtcggtttctccgacaccaagccgctgatcgacccgaaggacccccgctcgatcacgatgaaccgccgggtggacgtggtcgtgctgaccatgctcacggccgaccaggcggcgctgctgccgtcggcggcgggttccgacgcgaagctgcacgccggtcagaccacggccgaggcgaaggcactggagaaggcggtcgagtccgccaactcgtcgagcaccaccaccggtacgaccggcaccacgaaccacagcacgctgatcaccgctgagacccgtaactgagcaggggggagttctgatggctgacgagaaggacgcggctgcggaagcgccgaagaagtccaagaagatgatgatgatggtgatcgcgctggcactggtcgtgctgggcggcggtggcgccggagcgttcttcatgctccgcagcagctcggcgtcggcggcaccggtgaagggcatcgtcaccgcggcggagaacaccatcacggtgaacctggccgacgggcactacctgaagctcggcttcgccctgcagcagaccgacgcctccgccgaggcggtcgacctgagcgaggcgtaccagctggcgatcgaggagtacaccggcaggacgattgccgagctctccaccgacgcgggccgcgccaagctcaaggaggagctgaagggcaagctgatcgcggcgtacaccgagaagaagaagaagctcgtcatggacgtctacttcacctccttcgtgacgcagtagtcgccggcaccacgggcgggcctcctccgggaggcccgcccatcggtgtatcgagaggataaaacggccccggggctcagcggttcgcgaagtccgccgatcaggacgacgtgaccaccaccgcacgcacccccggcaagatgtcgcgccgtggccagggcggagggccgacggcctacgacttccgccgaccgatcaagctctcccgcgagcatgtccgcaccctgcagatcgccttcgagacgtacgcccgcagttgcggcaccctgctgaccacccggctgcgcgcggtcagcaacgtctcgctgatctccatcgagcagctgaactacgacgagtacgtggcgtcgctggccaacccgacgatcatcggggtggtcgccctcgatccgttgcccggcacggtgctgatcgagatcgcccagtccgcggtgatgaccgcgatcgaccacatgctcggcggccccggcggctcccagccggagcggccgctgaccgaggtggagatgccgctgctgcgcggcctgatcgagcggatgctgggcgagctgcgctacggcttcgagagcctggtcgacatccagccgcacctcaaggagatcgagtacaacgcgcagttcctgcgggcgcacgcgcccggcgacgcggtggtggtggcctcgttcgagaccaagatcggcgccgaggagtgcatctcgacgatctgcctgccgttcaacaccattctcccggtgctgtcccggcaggaggcggtcgtgctcagtgcggccgaacgccaggtcaaggacaaggcgctgcgcaatctcacggccggactttccgccgctccgatcgacgtagcagtgcgattccagcccattcggatgcgcaccgatgacatcgtggatctacgtccgggtgacgtcgtgccgctggggcatccgaccagccggccgctagaggtgaccgtgaacgacatcgtgttcgcgcatgccgttcccggtaatcagggtgcccggctcgcctgtctcgtcgtgccgtcccccaccgagaacgaatccaaggagtctggccgctcatgaccgcccctgccatcaccgcgccgcagctcatcctggcccggaacgcggcggacgccgcgctggccgtcctgcccaccagccgggcactggtcgccggcgagccgatgaccccggacgggacgaccgcgatcgagggccaggcggtcaccgcgcgcttcagcggacccgccaccggcgaggtggtcgtggtggtcggtcaggacctggcggacgcgctcaaggagagcccgctcggcgaactcgacctgaccgcggcggtccggcccgcgctggaggccgcggcccgggtcttcgggccggtcgtgctggatcccggtcaggtgatggagccgcaggtcgcgctcagcgcgctggccgccaaagagggtgcggtcgccatcccgctgcgcgacgacgaggacatccgcgcgatgctggcgctgtcgttgagcccgtggccggacgatgatccgctggtggccgccgcgaccggcggcggggtggcccagcgcgccccggaggcgccggcggtcggccggcgcggcggcctcgacatgctgcacgacgtggagatggaggtctccgccgagctgggtcggacccggatgagtgtgcgggagctgctgtcgctcaccccgggcgccatcgtcgagctggaccgggccgccggcagcccggccgacctgctggtcaacggccggctgatcgcccgcggcgaggtggtcgtggtggacgagaacttcggcatccggatcaccgagatcgtctcgccgggcgccgagtaggggtcacgaccagtgttccggctcctcatccaggtcgccttctccctgttcatcgtgctgttcatgatgtgggggctggcccgggcgctacggcgtccgttcggcgggcgcggccacggcccgctcaccgtgctcacccggcagcagctgggccgcagctcggcggtggcggtggtgcgggtggccgatcgggcgctcgtgctcggggtcaccgaacagcagatcagctatctgggcgaggccgagctcgacgtgttcgagcacgagaaggtggagcaccgggaccacctggtgctggagccgaccgagctgatcgacccgggcgggacggccctgccgggccggcatccggcggcgccggtggagcacggctcgatcctgtcgcccaagacgtggagctcgaccgtggagttcctgcgggagcggacgacccgaaaatgatgcgacgcgcgttgatgctgctcatgctggggatcggactcgcgctggcgatgccggccgcggcgggtgccgcgcccgggcagcagcccggcgcggcagtcgtcgtaccgccgcaagtggcgccgcgagcacccgcggagccgccggcgttgccaccgccccggctggtgccgcaggcaccgcgcacgtcgccgccgagcatcaacctgaacatcaacggcaccaacccggacggcagccgcccggcgtccagcctggtcatcgttctgggcctgacgctgctctcggtggcgcccgcgctgctgctgctctgcacgtgtttcaccaaggtcttcatggtcctcgggatcacccgcaacgcgctgggcctgaccacgctgccgcccaaccaggtgatcgccggactggccctgttcctgagccttttcatcatgggaccgaccgtctccgagatgaacaaggtcggcgtgcagccctacctcaagggcgacaagacccagtcgcaggccttcgacgacggcatcaagccgctgcgcgagttcatgtggaagaccacccgcgaggacgagctggccctgctgatcaaggtgtccggtgagaagcagccggcgaaccgggacgcggtgccgctgaccacgctggtgcccgcgttcgtgctctccgagctgcgggccgcgttcatcatcggcttcgtcatcttcatccctttcctgatcatcgacctggtcgtgtcggcctcgctgatgtcgctgggcatgatgatgctgcccccggtgaccgtcgcgctgcccttcaagctgctgctgttcgtgctggtcaacggctgggggttgatcatcacggcgctggtcgggtcgtaccggacgtgaactacgacgtgccgatcgcgcagatgctggcgatcctgctcggggcgtgccggaccggggcgtggatggtgatctgcccgccgttcaacacccggctcatccccggcccggtcaaggcgctgctctcggtcggcctggcgctgccgatggcgccgtacctgaccggcaccctgccctcgctggagacctcggcgctgctgttcagcgtgctgatgcagatcttcatcggggtcgcgctcggcttcatcaccatgctgctgttcgccgcgctgcaggcggccggtgacctgctcgacctgttcggcgggttcaccctggccaccgcgtacgacccgctcggcttcaaccagagttcgatcttcggccggttctacaacctggtcgcgatgaccctgctgttcgccggcgacgggcaccagctgatcctgcgcggcttcatgcagagtttccgcacgctgccgctgaacgtctcgttctccccggagacgttcagccggctgctgctcagcggcgtgggtgagatgttcgtgtccgccctgcagatcgccgggccgctggtctgcgtgctgttcctggccgacgtctcgctcggcctgctgaaccgggtggcgcccgcgctgaacgcgttccagctgggcttccccgtcaagatcttcctggtggtgaccctggccgggctggccatcgcggcgctcccgagcgtcctgcacaccctggtcgagcgcgcggtcacggcggtgatccggctcagcggcggctgagggggtgtagatgtccggcgagaagaccgaacagccgacacagcaacggctcaaaaaggcgaaacaggaaggacagatcggccgtacgccggacctgggcgcctggctgggcatgctggccgcgagcgtgctgctgccccgcaccctgacgcaggcgatgcagcacgccgaggaggcgatcgccaagctgccggacaccatccagaacccggacccggccaagggcctggccctgctccgggaggggctgttcggcgcggcctgggcggtggccccgctggcgctgaccatgatggcggtcggcgtcgccgcggccggcgcccagggcggcatccgggtcgccaccaagctgttcatcccgaagttcaaccggctcaacccgttttccggcctgaagcggatgttcggcccgcacgcgctgtgggagctgaccaagtcgctgttcaagaccgcggtgctggccgcggtcctgtacatgacggtcaagaacatcgtcccgcagctgatgtcggccggccggctgccgctgaccgcgctgctcggcaccgtcaccaacgcggtgatctcgctgatccgggcggccgcggtggccggcatcgcgatggccggcgccgactacctggtggtgcgccggcgcacccagaagcaactgcggatgaccaaggaagaggtcaagcaggagaacaagaactccgagggtgacccgctgatcaaggcgcagatccgggcccggcagatggccatggcgcgcaaccggcagatggccgacgtgccgaccgcggacgtggtggtggtcaacccggtgcacgtcgcggtggcgctgcggtacgagccggagaagggcgcgccgcgggtggtggccaagggcaaggggccggtggccgccaagatccggcagctggccaccgacaaccgggtgccgatggtgcaggacatcgcgctggcccgggcactcaactcggggtgcgaggtgggtcaggagatcccggccgagttcttcggcgcggtggcgcgggtgctcgcgttcgtgatgagcctcaaggcacgcggctcggcggccggtctgcaccgcagccccgccatgacgtaaccgaaatttcgggagatttcctcacatcggcgcgggttagcagggaagatcggggcgtggcggtgccacaggggtctcagtgacacggcgacggaacgccgagcggaggtgtcgtgaaaggccggaacctcggaaagctcgccgtgcccgtcggggtgatcggcatcatcatcatgatggtcgtcccgttgccgaccttcctgctcgacctgttcatcgccatgaacatcacgatggccctgctggtgctgctgatcagcatgttcgtcgagaagccgctcgacttcgcggtcttcccggcgctgctgctggtgatgacgctgttccggctggcgctcaacatcagcgccacccggctggtgctgcgcgacggtgacgccggcaaggtgatccatgcgttcggcagcttcgtggtcgggggcaacctggtcatcgggctggtgatcttctcgatcctggtcatcgtccaattgatcgtggtgaccaagggtgccgagcgggtcgccgaggtcggcgcccggttcaccctcgacgcgatgcccggcaagcagatggcgatcgacgccgacctgaacgccggcctgatcgacgaggacggcgccaagcggcgccgggccgaggtggccgccgaggccgagttctacggcgcgatggacggtggctccaagttcgtcaagggcgacgccatcgcggccatcatcatcacgctgatcaacctgatcggcgggttcgcggtcggcatcctgcagcacggcctggcgccggccgacgcgatgaaccagtacagcatgctcagcatcggcgacggcctggtctcccaggtgccggcgctgctgctctcggtggccaccggtctgatcgtgacccgctcggccacctccggtgacatgggccagaccgtcaccgcccagctcagccagaacaagctggcgctgcgcatcggcggtgccgcggccctcgccctctgcgtcatccccggcctgcccaaggtcccgttcctggtggtcggggtgaccgtgctggcgatcgcgcagcgggtcaaggagcagatcccggaggagaccgcgccgatcgccgaggcggtcgagatgccggccgccgactcgcccgagcagctgctcggcgagatgcggatcgacccgctggagctggccctcgccccggacctggtcgacctggtcgacgccagcagcggcgacctgctcgaccgggtgcgcgcactgcgccgcaagatggccctggaactcggggtgatcatgccgccggtgcgtacccgggacgacctggacctgccgctctcgtcgtacgcgatccggatctccggggtcgacgccggtgccggacaggcgccgcccggcacggtgctggcgatcggcgagggactgcaggcgctgcccggccgggccggcgtcgaaccggtgttcggcctggccggcaagtgggtcccggccgagatgcactatcaggccgagctgtccggcgcgacggtcgtcgatcgggcctcggtgatcatcacgcacctggccgagatcgtccgcaacaacgccagccggctgctcggccgggaggacgtgcgcgccctgaccgagatggtcaagcgcacccacccggtggtggtcgaggagctgaccccggggctgctcagcctcggccagatccagaaggtgctgcaggcgatgctcgacgagggcgtgccgatccgcgacctggtccggatcttcgaggcgctctcgctgcgcgccaagacctccgccgaccacgacggcctggtcgaggcggcccgggccgcgctgggcccggcgatcgccgcccagtacgcgagcggcggccggctcaccgtgatcacgttggacccgatgctcgagcagagcctgctcgagtccctgcggcccagcgacaccggggccttcatggcgatcgacggcatgcgtgccgaggcgatcgtcagtgaggccagccggctcgccgaagccgccgagcagcagggcctgaatccggtcctggcctgctccccacaactgcggttgccgctgatgcgactgctgcgcgccggctcccgccgggtgcaggtgctgtcgtacagcgagatctctggttccaccgcacagatcgagacgataggggtggtgaacggtgcctacgcgggtgctgcttgagggaccggccatcgagccgttactggctcaggtacgtgacgagtacggctcgcgcgtccggatcatctccgccgacaaggtacgaagcggtggcatcgggggcttcttcgcgaagcagcactacgagctctccgtcgaagtaccggacgcacacgaggacagtgaggacatggcgcaacagaccgtcgccgagaacggcgcaaatccgctggaacgcctgctcgagcaggccgagtcgcgggaccggaacgccttcgacggcccgccgccgggccgcccgcccacgccgaaactcggcgcaggccccgggctgggcgagcgcttcgagcggcagggtggccgggacgccgggatcggtgacaccggggccgcgttcgccgagctgatggccggcctggacatggccggtcacctcggcgagacgcagcgcggcgggcaccgggtgcggcagaccgccgacgccggggtgcgcccgttcaccccggccaccgtgaccgaaccaccggtcaacggcggcggccggctgggactgccggccgcgctgcccgggcggccggcgctagctagctagccggcccgccgaaccggccgccgcgccgccacgggccgcgttccagaccgtgccgacgggcgcgccgatccggtccgccgccgaggtctacgggctctccggcgacgacgagccggcgccggtctccccgaccgcggccacgccgccaccgcccccggcgcccaagccggcgccgatccgggtcagcggcgacctcgacccggtgcagcgcaacctgatgaccgtcggcatgcccgaggacatggcgcggcagatcaccggcggcgacacctacgccggggtgctcagcgtgctggcctcccggccggccgcacccggcatcccggacggccccggggagatcctggtcatcgccggcgaggtgcacaccgcggtgccgatcgccaagcacctgctcgagcaggtccacgtcgaccagaatcacctgctgctggccgcgctctccacctccggcaccgggctgcactcgtcgcggctgatctccagcccggccgccgccgaatcgcgcgccgacaagctgcagacctcggaccacccgtggatcgtggtgatcgacgcgccggtgggcggcaccgacgagttctgggtcaacgagatgtgcgacgcgctcggcgcgaccgcgctgtgggccgtcgtcgacgccacccgcaaaaccgcggacaccgcccgccacctgcgcaacctcggcgaggtcgaggcgctcgtggtgcacagcgtggagctcacctcggacccggcgtcggtactcgggctggacgtgccgatcttctcgctggacggcaagccggccaccccgcacgcctgggccgcgatgctgtgcgcccggatcgccgccgaggtgatgccggccgccgcctcgccgcggcgggccacgcgagccgcccgccgatgatccggccgtcggtcctggtgttcgcgctgctgatcagcctgccggcgtggtaccggctggtcgtcgaccagctggatctcacccaggtactgattcggttcctgatcgcggtgccgatcgcggcgatcctgctggccgcgttccggttcgtcacgtccgggtacggcgtcaccgaggagaccccggggacaccggtcgacccggaaccgctgcaggagtgactggcaccttggggaagagctgccagcactgaagagggcgccggtccgcttgtcgcggaccggcgcccctcgtctctccggccggttcgtccggtctctcaggcgtggatgtccagccggcccggtgtcgcgcggcgggtcgcggtcggggccggctcagccggcagatcggcgttcggccgccccgactcgccgccaccgccgcgccgaccgaacccgcccccggcctcgaactgctgccgcgcctggtcctgcggcgtgccctgacgcaggtccagcgaacagttcccgaacccggaatcctgcagctcacgccgcagatcctcgatgccggcccggagtgcctcggtgcccgcctcggtgccgccggtgagctgcacgctgatgtccccgttgcggatctcggcgaccacctggaccggtccgaggtcgaccgggtgcaactgcacggtgagccggtgcacgccgtcggcgtccagccgcagcggcgcgatccgcatcgcgatctgctcggccggcggggccagcgggatcggcgtggagttctccgcggccgccgcggtgggtgccgccgcgccggccggcgctagctagctagccgcggcgcgctgcgtggcccgatcggtggccgcgcgcgtcgcgtcgcggtcgccggcggcccggtccgtcgcggtccggtccgccagggcgcgttccgtcgcggcccgttccgtggcggtccggtccgtggcggcccgggtgacatcgcgcgagccggtgccgcgaatcgcggcgccgcgcagatcggcgtcccgagcggcgttccgtagttcggtgctgcgggcggtggcgtcgcgcatcgcggcgctgcgggtggcgacgtcgcgtagttcggcgctgcgggtggcggcgtcgcgtagttcggcgctgcgggtggcggcgtcccggcggtcggcggtctgctcggccacctcatcctggtcgtcgcccagctcggcggagagcgccgacccgaagtccgcaccgtcctcgcgccggctgcccgcccggcggctggtctcggtcacgggccggtggtccggtcccgtcacggaactcggcatgatcatgcgactcctcactcgtccggtgttgcgggggcagcggcgacggtcagccgccgagcgcggccagcgccttctgcaccttcggcacgtacgcctgggtctcgctgaacggcgggatgccgccgtaccggtgcaccgcgccgccgcccgcgttgtacgcggccagtgccagcggcaccgacttgaactcgttgagcaggcccttgagcatcttcgcggcgccgttcacggcctgctccgggtcgaaggcgtcgtccaccccgaggcccttcgcggtgcccggcatcagctgcatcaggccctgcgcgccgaccttgctgaccgccttcgggttgtagcccgactccaccttggcgaccgcggccagcagcttgggggagacgtcgtagcgggcgccggccttgaggaacaggtccgcgtacggcaccccggccagcgagccgccggccaccgagccgcgcagcccggccggacgcagcgacgacatgtcctgcaccgcggcggccggcacgtcgtcgatgatccgccggatgccgctcggcttctcgtacaccgactcgatcttcacgtggtcgcccggcttcggcgccgcgatcatcttgttgtcgccgaggtagatcccgacgtggtgcaccggcgagccgaacgccagcacgtcacccggccgcgcgtcggagaggctggccaccggccgacccgcggtcgcctgctgccacgagttgcggggcagcttgatgcccagatcctcgtagacctgccggaccaggccggaacagtccaggcccttgctcgggtcggtgccgccgaagacgtacggcgtgcccaggtacttcttcgccgccgccaccacatcgttcccgctcgggccggacgccgcgcccggggcctggccggcgccggtcgcccgggccagggcggaggcgaacttgtccccggaggacgcggtcgggtcgaccgtcgcctgcggcgggttcaggcccagctgctcctgcagttcggcgatgcggcccagcaccccggtgacacccaggctcatgcgttgctcccgttctcctcggcactcggcgtctcgacgccccgagcggcattgcgtgccttcgcggtgaccgccaactcgtcgaggttggcctggtcgacgcgcagatcattggccttgaccatggcggcgtgccgctcggacagcatctcgaccgcacgccggcgcttggccgcgtcggtcagggcggccatcttctcccgctcgacctcctcggcgtcggtgaccatccgctgggcgccgaacacgccggcggccagcgactgccgggccaccagggcggccaccatggcccgggccgatccctcggacggtgcatcggccccgatcaggtccagttggcggcgcttcaccagcgcctgcgcctcccggatctcggcacgcgactggatcagctcgccccgcgcggcgtcctcctgcgccttacgtgcacgaagcaccggaacgagtcggaacgtgcggttcatgctggcctcctagcggggccgaggggccctcactctcccgcttcggcctgcgacccgctccgctgagcccctgcacccaacccgcaacgtccgtcccaccgactcccgcaccacaacccggtcgacccgccgcgccccgtcgcccacccggccggcccgctcccacgcggcgtcccgccggagccggccggcaggccggagccgcgccggagcgccggggcgagcggacctcgcggggcgcgaccagggtgggttccgccacggagcggggtggcagcacgtaccggggaagggcaggtgaccgcgaagccgccggcggaccgtgcccggcgagcggtccctaagtcgtcgccagaagggcgcgcaaggcggcccaggcgtcgtcggcggtgatgcgctcgtcgatgtcctggcgcaggaacgcgctgatccggggccaggccgcgttggcccggtcggcctccgggttggtccccggcacataggcgccgatctccaccagctcgcggacgtcgcggtgggcggccatcagccggcggagttcggtggcgtcggcgcgctgctcccgcgtcgtgatcttgttggcgacgcgggagatcgagtcgagcgcctggatgctcgggaaatgcccggcggtggccagtttgcggtccagcacgatgtggccgtccaggatcgagcgggccgcgtcggcgatcggctcgttgtggtcgtcgccctcgaccagcaccgtgtacaggccggtgatactgccccgggcccccggcccggcgcgttccaggaggctggccagcatggcgaagaccgacggggggtagccccgggtggccggcggctcgccgaccgagaggccgacctcgcgctgggccatcgcggcgcgggtcacgctgtccatcatcagcagcacatcggcgccctcgtcgcggtagtactcggcgatccgggtggccaccgagccggcccgcaaccggaccagcggcggggtgtccgaggtggcgatcaccaccaccgagcgggccaggccctccggcccgaggtcgtgctcgatgaactcgcggacctcacggccgcgctcaccgaccagcgcgaccacgttgagttcggccgaggtgccccgggtgatcatgctcatcagcgtcgacttgccgaccccggagccggcgaagatgccgatccgctggccgcggccgcacgggacgagcgtgtccaggacccgcacgcccagcgacatcggcctgtcgacgagctgccgttccatcgccgagggcggggcctgctcgatgcccaccagttcgccgcgcagcggtggcccgccgtccatcgggcggccgagcccgtccaggatgcgcccgcgcaggtcggggccgaccgggatgcgcagcggcccgccggtgctgaccgccggggtgccggcgccgatcccggcgatcgggcccagtggcaggcagttgagctgctgtccgtccagcgccgccacctccgccagcaccgcgtccgggccggtgccgatccgcagcagctcgccgacccgggcttcgagtccgctgaccgtgacccgcaggccgaccgccccggtgacccggccggacaccgagggccgggccgcctcgaccgcgctgcgcaggcggtggtggaagacgtcggtcacagccgcagcgcctcccgggcccgggcgacggccgcctcgatggtcgcgtcgacggtcgcggtgccggtctcggcgatcgcgtcgcccggccgcaggccggggtcggcgtgcaggtggatctgccggccctggtagtcgaaggtgcccgggtcgtcgccgaccaggtgggcgtagtcctcggggtgcagccggacccgcacgtcgccgtgctccggcgcggcggtcatggcgcggcgcagcgcgtcccggccgcgctccggatcgtcgcgcagggtccgcccgatgaccgcctcggccaactcgaacgcgctgctcagcaccaggtcctgaagttcggtgaaggtcggcatgagctggttctccagctcggtgacggcccggccgagggcgttcaccgcgtgcgccagcgcggccgcccggcggtgctcgtggtgttcctcggcggcccgggcccgggccgcggcctcctcggcggccgccagggcgtcgcgtttgccctgcgcccagccctcggcgtagccggtggtccgggcctgcagccgctcctcctccaactgcttcggatcgttcggctcgggcatccgcaggttggtggcgaaccgggcggcggtggcgttctcggccaccgccccgcggatcaccgaccggtcaggcgatgagctcatcggcctcgccgccccgctggatctcgatctggccggagtcctccagggtgcggatgacaccgacgatcttggcctgggactcctcgaccatcttgaccttgaccgggccgagcaggtccatctcctccagcaggttctcccggccgcgctcggagaggttcttggtgaccttgtcgcgcacgccctccggcacccccttgagggcggtggccagatcggccggctccacctgacgcaggatcagctgcaccgcgcggtcctccaggttcacgatgtcctcgaacatgaacatccggcggcggatctcctcggccagctcggggctgcgggcgtccagggcctccaggatgagccgctcggtggtgcggtcggcccggttgatgatctcgaccagcggctgcaggccgccgaccgtggacagttcgtcgggctgcagcacgctggagagtttgcgctgcaacgcactctccacctggcggatgatgtccggtgaggtgcggtccatgatcgcgatgcggtgcgcgacctcggtctgcacctccagcggcaggccggccaggatcgacgaggccaggccggccgggatgtgggcgagcaccagcgcgatcgtctgcgggtgctcgtactgcacgtacgagagcagttgccgggggtcggcgttgctcaggaagttgaacgggatgtcgttcatcgacgcttcgagccggtccaggatcagcgccgcccgctccttgccgagcgacgcctccagcagctcccgggcgtagtccatgccaccggcaccggcgaaccgggtggtcgccatcgcatagaactcgtccatcacgtcgtcgacctggacggggtcgagcttgcccagtcgcgccacctcggcggagatggcctcgacctccttctcggtcatgttggccagcacctgcgcggattgttccttgccgaactggatcagcattatcgcggctttgcgtacgcccgtcatggagagcgtggtgagcgcgggtgtggtcaacgcctactcctcgtaccgtctttgctgctgtctgttccgattgctcagcggtgcgtagcgtcagcagacatccagcctcgcaggagagtcgccatctcgtcgggcttctccttgaccatctcctcgatctcgcgggtccgttcctcgcgggcctcgtcgcgctcctccacggcgaccccgccctcgatcatcgcggcggcgtgcatggcctgggtggcctccagttcggcttggcgctgggcgtccagcgcggcctgcatctcctccaggtgcgccttctcctcggcggtgagctgctgacgccgcttggcccgccggctggcccgccaggccaggaagaacagcatcagcacgacgaacgcgagcgcgccggtcttgaccagggtgagctgcttgttctgccggtccgcggcggccgccgcggccagttcgtccttggccgcctgctgtgcggagttgtcgaacggcatggcgctgaccgcgatgctgtcgccgcgggtggcgtcgatcccggcggccgagctgaccagctgctgcacctgggtcgggtcgatggaggcggcggtggtgctgtccagcaggaccgccacgttgagccgccggatgctgcccggggccttgcggcgcacctcctgtacctcgttgagcgcgttctgccgggcgtcgttcttgttggcgtactgcccgttggacccggcgccgttcggcacctggatgttgtccgggccgagcacgccaccgttgttgccgccactgccgctgtaggtctccgagctgctcgtctcggagagcgacggcagggacggatccgagctgtacgtcttgctctgcgtcgtggtctggtcgaagtccaggtcggcggtggtggtgacgaccgagtggccggacccgaccagccggtccagcatggcctgcagcgaggcgttcatccggttctggaactcgacggtctgcgcgtccgagccgctgtccccgccggtcgcgacggccgcgccgccacccgtggagaggatcttgccgtccgcgccggcgacggtgacctgggtcgggtcgaggccctcgacgctggaggcgaccagatgcacgatcgcctgcacctggtcggtgctgagcggggtggtggacttggaggcgaccagtaccgaggcggtcggcttggcggcgttgtcggcgaagacgtccttctgcggcagcaccaggtgcacggtggccgcctcgacgccgtcgatcgacttgatcgtcttggccagctcgccctccagggcccgctggtagttggcgtgctgcatgaagtcactggtggtgatgccctgctggtccagcagcgagtagccggtgccctcgtcgttgggcaggccctggccggagagctgcagccgcagagcgttcacctggtcgcgggggaccatgatggtctggccgtcgttcgccagctcgtagctggtgttcgacttctgcagcgactcgacgatggcgctggcatccttcgtcgacaggttgttgaacaggatcgcgtacgacggtttcgccgcccacgtcgcgaagaagtaccccccgacgacgagcgcgatgatggcgaagatcgtgacagccttctgtcccggcgtgaaggacttgaaggtgtccgtgatgcggcgtaccggagcgggaaggcggtcggtcatgtcaggcctgcatcctcatgatctcttggaaggcttcgacggccttgttccggatggcgagggtcatctggagcccgagggaggcctcggtcgcggccatcgtgtactgggccgggtcctgcagcgtcccgttggccacctggactccgaggtcgttggccttctcctgggacgcctggacgctctggagtcccttggagagcatccgggcgaagtcggtgttggggctggaggtcttggcggcctcatccagattcaagtcatctgaaatgccagacattcccgaaattccggaaatgccactgaagccggagacggcgccgatggggttgatcatgattacttcccgaggttgatagcggccgcgtacgcgtcgcgtgcccggtcgacgaccgacagattcgcctggtaggagcgctgcgccatgatcatctgagccatctggctgcccatgtcgatgtccggccggcggacgttgccctgcgcgtcggcgagggggttgtccggctcgtaggtcacgatgccctcggggttgcccagctggatcccggccacctcggcgccgttgccgtcctgcgccgcgcgggcctgcacgtaccgggcctggaaggcgttctcggaggtgcggctggtgttgttcatgttcgcgatgttgtccgagacggcgtcgagccacttgcggtagaccgtgaccccggtgcccgcgaccccgatggcgttgaagatgctcatcgtcaggctcccttgatggcgtcgcgcagcaggccgtacttgctgtcgatggcccgcagggtgagctggtagcgcatcgtggtgtcgatgtgcgccaacgtctcctcgtcgaggttgacgttgttgccgttgagccgggtcggctccagcgactcctgaacgctcggggtgatgcccagcggcgactggccgcgagcgaccgcgccctgcagggcctcctcaaacttgaccttacgggcccggaagcccggggtctcgacgttcgcgatgttgtcggcgatggcgttctgccgggccgagagcccggagaccgcgacgcgcagtgcgttcgtggaaaggtcgtcgaacaccttgcagctccctgatcgaagcgtccggttgccgatccatggcgggttggtgagcaatccgtgctcgtaccatgcagttcggcgcggccggcgatccgctgagcgtcagacggttgctgcgaggttgcacacgaaaacgtcccggacctccgtggcggaggtccgggacgccggcggtatgcggttgtcgttgcggatcacatggcgcagtcgacgtagaccgggcgtttgatcacttcaccggtctcgatccgcgaggtgaccgtctgctgctgccggttcgccaccagccggcgggcgagttcctgcgccgcggccagctgccgggtgaggatctcgtccgcccgcggcttgagctccagcggcagcgcgcccaggtcggtcggcggcttccagatgtcggccggcggggtctcggcgtgccggtgctcgtcggcgagcatcgcctcgaccgccgcgacgtccatctccagttcgtcgagggcggcggtccaggcgctgcgccagttgtcggtcatggcggtgctcacttcgccgcgacggcggcctcgcgccacgcgtcgcgcagcggttccagaagggtgcggcagccggctacccgctccgggctcttcgcgatgttcgcgccgatcagctcggtgaggatgaagccgtacaggttcgccaggccgggcgcgccgtcccaggcctccaggtccagggtgacccgcagctccagcacgatctcctgggcgtgggtgatccgctcgtgcgcggcgtcccggtcgccctcgcgcagcgcctcctcaccctgggtcaggtcgaggatcagccggtcgtagagcatcaccagcagccgggccggggaggcggtgttgatcgagtcctggaggtaacggtcgcggaggtgagcggcggtcatcgggtgtcccctcggtcaggcggcgtgcgggcgggtcgggtcagggtcagtgcaggccggcgagctgaccggagagccaggtcccctggtctttcagcttgccgagcgccgcctcgaggccggcgtactgcttctgcagcgcttccttccgggtggccagccgcacgtcccagttctcgatctggtcgttcagcgcgtcgatctcgttgttccggccctgcaccaccttggtcacggtgttcgtctgggtggtggccagatccttgacctgcttcgcgaaggcggtgccggcctcctgcaccttggccgggtcctcgttgtacgccttggtgaacgccgccgcgtcgaaggtgagctggccggtgctgtccaggccgatgccgaactggctgagcgagccgaagccgaccgccgcggtcgacgtggtgccgtccgggttcttcgtcgtcttgtcgtaggtcagcccgttgctgaccaggctcagcgtctgctgggtcatctgccggacggtgaagtcaccggtcagcggcgacgagctcttggtggacgcgtcgtacttcgtctggtccttgatctcgccgagcgccgcgttcgccgcgtcgaccatcgcctggaacttgccggcgatcgcgttgacgtcggtggtggcgcccaccgtgacgttctgctcgaccttcgacgcggtgatcgacacaccgggcatcagcgtgctgaacgtgttggtgctgctggagaccttgtactcggtggaggtgccggggttcagggtcagcgtcgcgtcgcgcgccgaggtgtccgccggcggattgccgtcactgccggtcagaccggtgatccggaagccgttggcggcgccgctcttgttctgcacgaactgcatcacgccggcggtgtccccggtcttcaccgtgtaggcgcggatgccgagcccggcgtcgttgaccgcggtggtgaccgcgtccgcgtcgtacggcttgccgacgttgaccgtggtgaacgagccggagccggtgaagacgtcggcgccgttgctgtcggtcgaccaggtgccggtctcgacctggaagctggacgggaagccggtcgaggtggtgtcgacgttcagcgtgctggtctgcgcccgggccacggaggagacgtcgaagttgatgctgccggccatgccggcgaggccgccggtggccttggcggtcaccgtctgggaggtcgacgtcgcgttgagcgaccgccacgaggccagcgagacgacgtcaccggcggccgacttggtcgcggccagcttggcgttcaccgactggtatgaggcgaccgcggtctgcgcggtctgcaccttggtcttgagcttggtctgtggtgcggcctcgacctgcatcagctgagcgatcatcgaggaggtctgcatgccgctgacgaggccgtcgacggagctggtggacacgagggccgcctttcatgctgcggggtaccgaggagtggcgaaggggtagccggctgggctcgccggctaccccttcctgttcggtcgttcgggaacctgattcagtcgctaccggtagtcatccggttgcgatcagggtcagcgcaggagcgacagcacgttctgcgcggactggttggcctgggacagcatcgaggtgccggcctgggtcaggatctggttgcgggtgaaggacaccatctcctgcgccatgtcggtgtcgcggatccgggactccgacgcggacaggttctcgaccgccacgttgaggttgttgatggtgtgctcgaaccggttctggtgcgcaccgagctgggcccgggtggcggagaccgacttgatcgccttgtccacggcgtcgatcgcctgcgaggcgccggacggcgtcgtgccgacggccgccgtggtcaggttgaggttgttgaggcccaggctcttcgagctgacctcgttgatgtggacgcccagcttctcgccggagttggcgccgatctggaagtcaccggaggccgcgctggcgttggtctggctcgccccggccgtgaccaggttcgacgccgtgacgttgaaggtcgacgagctgttgacctcgaaggtgaccttgccggtctcgtccgccttggcggtcacgctgatctcgttggggtcgcggccgttcgccttgagagctgtctgcagctgcgtgttgatgttgtcggccacgtcctgcggggtcgaggcggtgccggtggcggcggtggtgaaggacgccgcgatgggcgtgttcagcgtggtgccgccgaccgtgtcgatgctcagcgtcatggccgtgccgcccgccggcatcacggcgggagtggtggtcaccaggtggttggtgttgccgaaggagccgtcgagcagcttcgacttgccgaacgcggtggtcgtggaaacccggtcgatttcggagctgagctgcgagaactcgtcctgcgcggcctgctttgcgtcgctgtccagcgaggcgttgctggcctgcaccgagaggtcacgcatgcgctgcagcatgctggtggtctcgttgagcgcaccttcagcggtctgcacgacgctgatcgcgtcctgggcgttgcgggtggccaccttgaggccgccggtctgcgcgcgcagaccctcggagatcgagaggccggccgcgtcgtccgccgcccggttgatccggaacccgctggacagcttctccagcgacttctgcatctggttgtcggtgaccgacaggttccggtacgcgttctgggcggcgatgttctggttgatgcgaagacccattgggtgattcctccttgactggggtcttgagcggcccgtccatgagccggtgttgcgacattcccttcggcggagggtcgcgagcgactgaggattctccgagaattcttccggcttttcgggtcaaccggataaatgccgattgggggaaaccactcagcggtacggcgaacatgccgacctgtccgaatgagcgggttgccgaaagggtgcagcccgacccgcgaaccgacggaggaccgggtgagcctgaccgacctggccagcgtcctgtggcgctctcgcgagctgctggagatgctgcttttcaagctggaggaggagcagttgcttctcgcggccaaccgatcccgctggctcagccacgccacccgtgaggtcgaggtggtcctcgaccagatccggcagaccgaggtcatccgggccgcctacgcccaggacgtcgcggccgagctgggtctgcccgtggaagcgtccctcggcgagctcgccgacgccgcgccggatccctggtcggacctgctgcatcagcaccgtaaggcgttcctgctcctgacgtcggagatccgggccctggccgacgtcaaccgggacctgctcaccgcgggacaacgcgcggctcgcgaaaccatgctcgtgttcgccgagactgtggaaacgtacgggccgcagggccagaccgtcaccggcggcgtgcgccgccccaccctcgttgatgaggcgatctgatgggcagcactttcagtggactcaacacggctctgacctccttgtacgcgcagcggcgcggcctggacgtcaccggccagaacatcgcgaacgcgaataccgagggctacacccggcagcgggtgaacctgcagtcgcagaacggcaacgtggttcccggcgtgtacgccaccaccagtgcggtcggcggcggggtcaccgtctcctcggtggaccggctccgcaacgccgcgctcgaccagcgcagctacagcgagcactcggcctcggcgtaccacaacgcccgggccgggcagttcaacctggtcgaggacgtgttcgccgagccgagcgacacggcgctgcagggccggctcgcggacatgtgggagggctggaacgcggtcgccgccaaccccagcgacctgtccgccaagtcggccatgctggagcagtccagcacggtcgccgccaccctgaacgacgcggcctccgcactgaacaaccagtaccaggcggcccgcaccgggctgaacacctacgtcgacgacgtcaacaaggcggccgactcggtggcgaagctgaacaaccagatcgtcatcgccacccaggccggcctgtccgcgaacgagctgcaggaccagcggggccagcagatcctcaagttgtccgaactgatcggggcgagcgccaccgagcagccgaacggcgcgatcaacgtcttcgtcggcagcgcgccgctggtcagcggcttcaacacccggcagatcgagatcgagccgggcagtgccacccggatcgaggacctggccaccagcgaggtcaacctgcgctggtcggacaccaaggcggcggtcggggccggcgggacgatgggcgcctcgatggaacttctcgccaagggcggcacgctggacgcgatgaccaagcggctggacacggtcgccgacaagctggccaccacggtcaacgcgatctacaagaaggggtacgcggtcgacggcacccagggggagtcgttcttcgtccgcaacgacaccggcgccgacaccggggtgaccgccgcgcagatcaaggtggcgatcaccaacccggcgaaggtggcgatctcgtcgggcgacccgaccggcgcgcccaccgcggccagtcccggcggcacccccaaggtgctcgacggcaaccaggcggacgcgatcgccgagctggccgactcgcggaccggcgcggacgccgagtacaagtcgatgatcggcgagctgggcgtctcggcccagtcggcgatccgccggcgtgacgtgcagaacgcggtgaccgatcaggtcgacgccgcccgggactcggaggccggggtcaacctcgacgaggagatgacccacatgctcacctaccagcgcgggtacgaggcggccagccgcgtgctcaccaccatcgactcgatgctcgaccaattgatcaaccgcaccggcatggtgggtaggtaagggagtccgtcatgaccagcccaagggtcaccgagagcagcgtgcgcacccgcgtgatggccagcctgcagcgcaacctgagccgcagccaggaggcgaccgaccggatctccagcggcaagcagctgacccgcccgtcggactcgccgaccggcacggtcaccgcgctgcaactgcgtggcgaggtgcgggccaacaagcggtactccagcaacgccgacgacgcggtcggccggctcggggtggtgcaggacaacctgcagcagacccaggagctgatcaccgtggcccgcaacctgacgctggaggcgaccagcgcgggcggcggcggcaccccggaggcgaacaaggcccgggccgcccagctggagcagatcaagggcaacctgatccagttcgccaactcgaagtacctcgaccggccggtgttcggcgggagcacgccggaccacgaggcctacgacagcaccggcaactacatcggtgaggggtccggcgagaccctgcgcgcgatcggcccgaacgccaaggtccgggtcgacgtgcggggcccggaggtgtacggcgccgacaagatcaccgatgccaacggcaatcaggtggacaacccggagcagttgttccacgttctcgactcggtgatcggggcgatgcggagcggcgattccaaggctctggacgacggtctgaagaatctcgataaatccgctgatctcctggaatccactctttcggacgtaggtgcccgatacaatcgggttacgcagatgaagcagtccgctgaggatcgtttgtcgtccgtgtcgtcgcagttgtccgatatcgaggatgtcgacctgcccaaggcgatcatggaaatgcagctccagcagacctcgtatcaggccgccctggccgccacggccaaggtgatccagccctcgctcatcgaattcctgaggtgaacatgactactcgcaccatgtcccgaccgatcgaggccaccatgaccgatccgtcgctgggcctgccgaccatctccatggcgatccccatgccgggatttccgggacaccgggagttcgttctggtgcgcctgaacgacgacggcctgctctacgcgctcacgtcggtcgacgatcccgagcttcgtttcctggtggcgcctccggagccgttcttcccggagtacgccccggagatcgacgagtcggtgttcgcggcgctgaacaccaaggacccggaccgggtgctgctgctgaccgtgatcaccgcgagcaaggaggagaccaccgccaacctcctcgcccctatcgtggtggaccgcgacagcatgcgggccatgcagacgatcctcaccggctccggctacccggtccgggcgatcatgaaccgggcgttctgaacctgcacgtgctcaggcgcggtcgcgttccctcgcggccgcgcctttgccatgctgtccgttccatggatggaaggggagggcgtcatgcttgtgctgaccaggcgggccggggagagcgtgatgatcggcgacgacgtcgtgatcaccgtgctggaggcccggggtgacgtcatccggctcggtatccaggccccgcgggacgtccaggtgcaccgcgaggaggtgtaccgggagttgcaggaagcgaaccgcgccgccgcgtcgccgaccgacgaggcggtggacgccatctcccggatggtgcgggagaagccggccggctgacagcgcacctcacctgcaccggccgctgaccccggagacaacgcggggacgggattcttcttcacgacggagaacttcagtcgtgggagcgatcgtgggcgcagagcgggaatcagtcatcggcggcagtgcggtcggcaccgtgtgcgcgctggatctgacggtggatgcccacgtgcacaccgggttcgcggccgggcgcgacgccgtcggcgtggtggtctcggccgccgaccgggccgggctgaccgcgctcaccttcgccgaccaggccgggccggacaccacctggctgaccgcgtacgcggatgcggtgcgtcgggcccggcaccgtaccgagatgaccctgcgggtggccgccgaggtcgaggtggtccgtccggacggctggctggcgctgccggccgacctggcccagctggacgccctgtcggtggcggtctccgccctgccgctcggcgacgagctgctcgacgcgcgggcggtccgggcccggttggccggcggcacgctgaccgccgagcgggtcgccgggcagctgatcacggcgatcgtgcagggcctggcccgcgcctcccgctacgtgccgacccagctggcccgcccgctggcgctgctcgcccaggccgggatcgacgacgccgcggtctccgccgagatgctcgccgaactggccgccgcctgccgggccaccggcaccgtggtggaggtcagcgaggcgtggcgcagcccttcgccgcgcctgctcgccctgctgcgtgacgccggcgtgaccctggtgccggcgagtgacgcccggtacgccgccgaggtcggcggctggcagtacctgcgccgcatctgaagtcctcgaaagtgaacacgcgccgtgctcgcctacgtactctctgtcatgccagcacttcagcatgggagagatgcgatgagtatggttcagcaggccatcgaggtgagtgcaccgctgcacacggtgtacgagcaactcgccgcgttcgagaactatccgcggttcatgaccggagttcgccaggtcaccacgaccggcggcgaccagacccactggatcatggaggtggacgggaagcgccgcgagttcgacgcccagatcatcgagcggtcaccggacgagcgggtctcctggtcgaccatggaggggccgctgctggccgagacgctcacgctgcgcccgatgggcgagacgaagacccagatcgtcgcccagctcgaggcggacatcgcgttcctgatgcccagcgaccggcacggccaggagtcgctgaaccgtcggctcaaggccgacctgaccaccttcaagggactggtcgagagcggcgtgctgggcggccgtccgatgccgaccggagccagcgtcaagcgcctgcccggcccctcgcacacgctgttcagcccggcccgcgactacgcctcgccggcctcggtcgccacccgggtgcacaagcatccgccggctgccgcaccgcacccgggcgccggctgggacaacggcgcggccggcgtcgagttgcaggacgagcccggcggccgggccaccggcagcgcggccggcaccgccccgatgggtggccgcaccgcgcgggccgacatgtggggcaacggcatgatcaacgaagaggatcgcggcatcggctgacccgccgtcgccgccgactgccgcatccgcccaccgggcgggtgcggcggttccgttctcatccccggggcgcggtctccaggatgaccagcaggcgggcgccgcgaggatcggcatgctcgtaccgcatcgacccgccgttcgcctccaccaggtgccgggcgatgaacaggcccagcccggcgccccggatgaagcggccgaacaggtccggcagcaggtcgtcggggatgccggggccgctgtcgcgcacctccagccgcacggtctccgggccgtcccggccggcccgcacctggaccggtgcggccccgtgcgcgatcgcgttccgcagcaggttctccaccacgatcgtcaggtgcccgcggtcggccagtgcggacaggtcctcgtcgatggtgacctcgacctggccggcgccggccgtctcggcgcaggccgcgcggaccacctcgagcagcgggaccggcacccggcgggcggtgaccgtaccggtgtccaggcggaacagcagctgcaggtcgttcatcatcttgatcaggcggcgggtgttcttgtcgatcttggtggccagctccagccggatgtcctccggcaggtcggcccagtcggcgcagagcagctcggccaggctggcgatcgagctgatcggctgcgccacgtcgtgggtcagcatcgaggtcaggtcgtttttgaaggccagcgcggcggccagctgcgcgttgccgcgttcgagctcggcggcgtggtcgctgagcgcgtcctcggcccgtttccgctccgcgatgtcgacgtaggtggcgacgtatccgcgcggggcacccgcctcgtccgggatcgcggcgaccgtggccagcaccggtacctcggtgccgtcggcgcgcgacagcagccagtcgccgccggcgccgggcagcggtgggggcggggcctccgccgcggagtcgtacccggtcagttcccgccagcgccggttgacgtcgatcacccggtagttgacgtcgagcaccatgacggcctcgtccatcgactgccacagcgtctcggcgtattccgggcgggcgtcgccgggacgacccgggtcaccgggccggatcgcggcggccgcgaccagcagcgccgcggtggcgacgacgaccagcgtcgacgccgacgcgagggcgaccgcggccagtacgcagagcgcgaccgccccggtccgcacccgaccgccccgcggcgccgcgtagatcagcagggcgagaccggccggaaacagcgcagccgccggagggagcctgagcccctccggcggcgtgagatcggtcgcgtgcgtgtgcagcaacccgaggacggtgaccgtgaccccggcgctcccggcgatcagccggtttctgcccacgccgcgcaccgcgatacgcacatatccccccatgacgtgaggaaatgagcataacgcggtcagcgctgctacttacccgcccaggcaaacccttcctccaggcggatcttgctggccacacgcgcgatctcggcgtgcatccggttcgcgtggtggccacagaaggccaggtcgccgccgctgctcagggtcacctccagcttggcggccgcgccacagcgatcgcagcgctcggtgagctcgccgacggtgtcgatctcgggcgacagcagggtggtcatatcgctctccttgctcctgggccgaatgaagctgggctcaacggcggtgtgcagcggtcctgacagcggactagatcggtaaccggcctggccgtcttagtggttcgaccggtggaaccgcccgtggtccggtgcaacctcgtcacacccggacgggaccggagcgtgcacttctccgacgtcagagtttcccccaagtcgccacggcatgcgtcccgcagccgaggtacctgacctgagggagacatttgatgctcggttccgacgcccgtcgcctggccgtccgtttcgcggccgtcgcgagcgccgccaccgcttctctttacggtttcaccggcgcggcctcggccgcaccggcaccggtcgctccggcgaccgggaccgtcctggaggccggggtggccggcgccatcccggacagctacatcgtcgtcctcaaggccggcgcttccgcctccccggacctcgtcgccggttacggcggtcaggtcctgaacaagtaccaggccacggtacgcggtttccacgcccggatgtccgctgagcaggcggcccgcctcgccgccgacccggccgtgcagtacgtcgagcaggacgccgtgatcggcgcgtcctcggtccagagcaacgccacctggggcctggaccggatcgaccagcgcgaccgcacgctggaccgcaagtacacctacggctcggcgaaggacgtcaccgcgtacgtcatcgacaccggcatccgtacctcgcacaaggacttcggcggccgggccagcagcggctgggacttcgtcgacggcgacaagaccgccgacgactgcaacggacacggcacccacgtggccggcaccatcggcggcgccacctacggcgtggccaaggacatcaagctggtcggcgtcaaggtcctcgactgcgacggctccggttcgtactccgacttcatcgccggcatcgactgggtgaccgcgcacgccaagctgcccgccgtggccaacatgagcatcggcggcccgcagagcaaggcgctcgacgacgcggtcgaccgctcgatcgccaagggcgtcgtctacgccatcgcggccggcaacgacaacaagaacgcctgccggttctcgccgtcggacacctcgaacgcgatcaccgtcggggcgatcgacaacgccgacaagcgcgcctcgttctccaactacggttcgtgcgtcgacatcttcgcgcccggcgtcaacatcaagtcggcgtcgagcgactcgaactccggcaccgagatcatgagcggcacctcgatggccagcccgcacgtggccggcgcggccgcgctggtgctcggcgcccacccgacctggaccccgcagcaggtccgcgacgacctggtcgcgcacgccgacgctggcctgatccgcaacccgggcaccggctcgccgaacaggtcgctctacaccggctacctctacgagaccggctccgccgccaagaagcactgatctcccggtacgcggatgtccctcgcgccgcgcgacgcctcatgcgtcgcgcggcgttttccgtgatccggtccggccgggccggggtcggcaaaccgccctactcgacggcccgtggcgactagcgtgagatcgaccccagcccgcgaggaggacccatgtccgaggcgccggtcgccgatacgccgaccgtcctggtcgtcgacgacgaagaagatctgcgcgacatcatgcgccgcatgctggagcgcaaaggctacgcggcgctgaccgcgggcgacccggacgaggcgatctcggtctgccgcgaccacccgggcgtgatcgacgtgctggtcaccgacctcaccctgcccggcggcaagtccggcggggagctggccggcacggtcatcaagatgcgcccgggcaccggtgtcgtgttcatctccggcctgcccaaggacatcgcggtcaccaagggcctggtcggcgacgacgccctcctggtgaagaaacccttcaccgccgacgctctgctggaggccctgaaacgggtcctccgcgacgaggcggagcgggacgacccgccaccgaactgatcccgctgcccggggcgggcgccgatcagcccggccagggcatactcagctcaccccggcgccagcgggccggcccgtccagcacgggccagccgtcggcgcgcatccggcggacggtggccagccagcgctgccgcgggccgaacggggtggcctcggtctcccacgcccgcccgagcgcccgcagcagttcgtgcaccggatgcccgggcacgttgtggtggatcagcgccttcggcaaccgttcggcgaagaccgccggatgctccagcaccggcagccgggcggacagcgtcagcgtcgacgcgacaccaccctcgaccaccgcccaggtggcgatccggcccagctcgtcacaggtgccctcgatcagcgtcgcgcccgttccggtcatctgccgccaggccgcggtcacctcgtcctcggcgtactggcgcagcacgttgaacgcgcggacgaccaccggggacagcccggccagctcgaacccgccccggcggaactgcaggaacgggggctcggcgaacggctgggcgtcggccacgcgtaccgggtcgatctccaggccgaccaccgtgacgtccgggcggaccgcggccgccaaccggccccgaagctcgaccgcggtgaccggggacgcgccgtaaccgaggtcgacgaccagcggcgcggccgcctcggacagcgcggccgcgcatcggaacgccaggtagttgtccacccggcgcagccggttcgggttggtcgtcccccgggtgatcgcgccgaccggtttcacctgcctagagctcccggtgcaccttgtgctgggcggcctgggcgatcgggcggaccaccagccggtcgatgttgacgtgctgcggccgggtggcggcgaacgcgatcacgtccgcgatgtcctcggccaccagcggctcggccaccccggcgtagatcgcgtcggcccgcgcccggtcaccgccgaagcggttcagcgagaactcgtcggtgcgcaccatgcccgggtcgatctccaccacccgcaccggccggccgacgatctccaggcgcagggtcccgaccagcgcggtctgggcgtgcttggccgccacgtaaccaccaccgccctcgtacggcgtgaacgccgccgtggagccgaccgtcacgatcgtccccgccccgctcgcctccagcgccggcagcagcgccttggtcacccgcagcgtgcccagcacgttcacgtcgaacatcgcctgccagtcctcgaccgcgccggacgccaccgggtccagcccgatcgccccgcccgcgttgttgaccagcagggccagcggcgcgccgagcgcctgcaccgcggcggccagcccggccaccgactcgtccgaggtcacgtcgcacgccaccgcggtcgcgcccgcgccgatctccttgaccagcgactccagtcgatccgcccggcgggccgcggcgaccacgtgaaaaccctcaccggccaggcggcgggccgtggccgcgccgatcccgctggaagccccggtgaccactgcgattctctgcatggctccgatcttccctcatgacttgagtcaccccggcccggctgcgtagtggttcagcacacgccgatggggaagatgacaactgcgcaacgacttttaccggtaggacccagcgggaggatcgaacgtggccgaggtcagctggcccaccccacggcggatcgccaccgtctcggtgcatacgtcgccgctggagcagcccggtaccggggacgccggcgggatgaacgtctacatcgtcgaggtgtccaagcggctggccgcggccggtgtccaggtggagatcttcacccgggccacgtcgagcgacctgccgccggtggtcgagatgctgcccggggtgcacgtccggcacgtcaccgccgggccgtacgaggggctgaacaaggaggagctctcctcccagctctgcgccttcaccaccggcgtgctgcgggccgaggcggcccacccgccgggccactacgacctgatccactcgcactactggctctccggccaggtcggctggctggcccgggaacgctggggcgtgccgcacgtgcacaccgcacacaccctggccaaggtcaagaacatgctgatcgcggccggcgaccgcccggagccgaaagcccgggtgatcggcgaggagcaggtggtcgccgagtccgaccggctggtcgccaacacccggttcgaggcgcacgacctgatcacccactatcaggccgacccggcccgggtcggtgtcgtgcagcctggcgtggacctggaccggttccgtcccggcgccgccgaccgcgcccggttcgggttgccggagtccggccggatcgtcgccttcgtcggccggatccagccgctcaaggccccggacgtgctggtctccgcgctcgccgagatgcgggcccgtggcgccggcgaggtcaccctggtgatctgcggtggtcccagcggcagcggcctggatcgcccgtccgcgctgatcgagctggccgcctcactcggggtcagcgactcggtggtgttcctgcccccgcagaccggcgccgacctggccgccctctaccgcgccgccgacctggtcgcggtgccgtcctacaacgagtcgttcggcctggtcgcgctggaggcgcaggcctgcggcaccccggtggtcgcggcggcggtcggcggcctggtcaccgcggtccgcgacggggagagcggcgtgctgatcgacggccacgacccggccgactgggcccgggtcctcgaccggctgctggccgcgccggcgtaccggcgccgcctctcggccggtgcggtggcacacgccgcgcacttctcctgggaccgcacggtcgaggcgctgctgcgggtctaccgtgacgcgatgagtgaacaccgggccctgatcacggcccgggtggagggggcgacctgcgcatggtgaaaaagttgatcgagcgggtgttgaccgaccgcgagctggaatgggagtcgaccggcgagtcgtcctatgtggtcaccttgcccggcacgcacaagctgaagaccgcctgcaacctgatcgtcggcgagcacgcgctgcggatcgaggcgttcgtgatgcgccagccggacgagcggcgcgaggatctgtgggcctggctgctgcgccgcaacgcccggatgtacggcgtcgccttctccatcgacgcggccggcgacatctacctgaccggccgggtgtcgctgaccggtctggacgaggacgagctggaccggctgctgggcgcggtgctcacctatgccgacgaatccttcgacacgatgctggaaatcggtttcggctcgtcgatccgccgcgaatgggagtggcgggtcaaacgcggcgagtccctggccaacctgcaggccttccagcacttcgcggctcccaccgagtcctgagcccggccccgcggccggacctcgttcccgggtgaaccgcggggtggggcctgctcgcggctactgttcgcactcgcggtcggggtggccggcaccggccggacggcctgctgtctccgccgaacgcccggttcccgccggttccgggaccgacggttttccactgtggagacgccgcgacggtgcggccggccgggcgggcccgacaggatcgccgtgacgtgccgaaacgtgatcatcgagcgagtaattcacccgcacgtcaccgggtggcaagctggcggcggctcggccaccggttcgatagccatcatttcctcatccggtatcagtcattatttccgccggtgtcgcggagtccggacgagtgattgccggatcgtccgatcggttggttgttggcgattgtgacgcctgagacagatgtcgacacgaatacgggttgtgaggcttgactgccccaactagcgtggtcgatggacaccgagccgttagttcggggaacgggacgatcagcaatgatctccgcggttcggtgtttggggacgggtggcataagccgttgggggacggcgcgacccgagaccggcggttagtgcgggcgacgcctatggggatgggggtcgcccgccgccgccggcgcttttctttgtgtgcacgtgaccgttccgtgcgcgcaggatcttccactcatcaatttttagcgaagcattccggcttcggtccgtccgatgtggtcggtcgccgatggcggtcggcggcgcggtggcgaccggcggcgcggtggcgaccggcgctagctagctagttgttcgcgggccgggtctgtggtggtggccggcggtgccttgttcgcgggccggatctgtggtggtggccggcggtgcgttgttcgcgggccggctcagtggcggccgtcggtcgcttgcggatcgacgcggttggcggccgtcggtcgtcggtgcgccggcccgggtgcggccgccgtccgggccgtgcgccgttcccgcgccggaccggcggccagatgcagggccgcggccacgatccccaccccggccacgatcggccagagccccggcccgagatgttccaggccggccccaccgagcgccggcgccacgaacgaggcgaacgggaagctcaggtagaacacggcctggtaccgcccgcggagcagcggcggcgccagctccgagttgatcgccgcattgggtggtgcggcgagcatcccgccgacggtccagacggcggccgcgcccagataggccggcaggctgtcggcgaccgtcagcgtcccgaagccggccgcggtcaccagcatcgccagggccagcacccgggccttgcggcgcccgtcgatgagcccgggcacgaacagctgcccgagcacgatcaacgccccgccgagcgcggtcaccaggccgtagtcgccggggccgagcccgtcggcgtgcatggccagcgggacgatcgtgttcgcctggctgctcagcagggcctgcaggacggtcagtccgacgaaggcgagaaagatccggtcggcgagcacggtgcgcagcccgccgggggcgccgccgcggccggcccggcccagcgtctccggcaccttccgggcgatgatcaccgcggtgatcagcgtgctggccgcgtcgagcaggaagagcccggggtagctccaccgggcgagcaacccggccagcagcgaggccccggccgtgcccaggttgaacgcccagaactgcaggttgaacgcccgcagccggtgctcgcccgggaccgtgtcggtgatcgcggcgacgaaggccgggccgggcatcgcctgggtcagcccgagcagcaggcagagcccggcgatcagcggcagcggcgtgctgacggccagggcgaccagcacggccgagcaggccaggtgcgaccagagcagggtggcccggcgtccccaccggtcggtgagcacgccgccggccagggtgccgagcacgccgccgatgccgtgggcaccgacgaccaggccggcgagtgcggccccggcgccgcgggccgcggtgaggtacagcgagaggtagagcaccgcgaagccgccgacccgattgatcagcagtccggtccacaggtaccagtacgccgtgggtagcccgccgaccgcggctcgcagccacccccgcatccgtccggccctcccgacccgcgctttgggaaagaaaccttaccgaacgccggagggggtgtccgtctcgcgagtgagcagggcggcccgccggacccgggccggaccggtggccaggtgtcccgcggcggccaccgcgcacaggccgaaacagccggtccacagcgcggtcgtgccccggtcctgcagcaccagcccgcccaggatcggcgcgagggtcccgccggccgaccaggacagtgagttgagtccctggtagcggccgcgcagcggggccggggacagggcggcgacggtggccgcgttgctcggcgactgcagcatctcgccgagcgtccagatcaccacggtgaccgcgtacatccaggcggcgtgggcgaacgtgaccagcccgaagccggtccccatgatcagtgcggcgaccgcgaggacgcggtgcgggcggcggccggcgatcagccgcggcacgaacaactgcccggcgacgatcaggaagccgttgaccgcgatcacccagccgtacgtcgcggcggacagcccgtcagtcagcatggtgatcggcagggtcgacaggtgctgcagcatgaccagcacggtcagcaggttgaccagcatgaaggcgaggaacgtgcggtcgcgcagcgcggtcgccaggccggcggccggggccacgccggaggcggccgggcggtgggcgggccgggtctcgcgcagcagcagcacggtgatcaacccggtgagcaccgtgctggccgcgtcggcgacgaacagcacggtgaagttcgcctcggcggccaggccggcgacgatcgcggcgagtgcgaaacccaggttgaccgcccagtagttcagcgagaacgcccggacccggtcacgctcgggcacgatgtcgaccatcatcgcgccgaaggccggccggaccccctcggcgaaggcgccgagcagggtggtgacgatcaggatgcccgggtacgggtgggtgaggccgagggtcagcatcagtgccgccgcgccgaactgggcggtgagcatggtcggtcgccggccccaacggtcggtcagcatgccgccggtcatcgtgccgaccgccccgccgacgccgtagaggccgatcaccaggccggcctggctctgcgtgaagtgccgctcgctggtcaggtagatgctcagaaacggcaccacgaacgagccgatccggttgatcagggtcccggtccagaggaaccagaactgccgcggcagtccgcccgcggcctcccgcaaccaacctcgcaccggagccccccgtaagcactgaacctgccctgtccgccttacaacctaggggatccggccatcgattttccacccgcccggaccgcccccggatcgtgcggggaagatgtgggcatgactggaaccctggtgctgttgcggcacggcaacagcgagtggaacgccaagaacctcttcaccggctgggtcgacgtggacctggacgccaagggcgaggatgaggcccggcgcggcggagagctgctcaaggaacagaatgtgctgcccgacgtcgtgcacaccagcctgctgcggcgtgccatccgcaccagcgagatcgccctgcacatcaccgaccggcactggatcccggtgaagcggtcgtggcggctcaacgagcggcactacggcgctctgcagggcaaggacaagaagcagaccctggacacctacggcgaggagcagttcatgctctggcgccggtcgtacgacgtgcccccgccgccgatcgaggacgactcggagttctcccaggcgaacgacgcccgttacgccgacctcccgccggagatcaagccgaaggcggagtgcctgaaggacgtgctcgaccgcgccctgccgtactggtacgacgcgatcgtcccggacctgcgggccggtaagacggtgctggtcgccgcgcacggcaactcgctgcgcgcgatcgtcaagcacctggacgcgatctccgacgaggcgatcgcgaagctgaacatcccgaccggcatcccgctgcgctacgacctggacgagaacctgcgcccgatcacggccggcgggacgtacctggacccgcaggcggccaaggaggccgcggccgcggtcgccaaccaggggcgctgacgcgctgagagccgggacaccgcctccgtggtgtcccggctcccggactgcccgatggtcagccctgacccgcgaccggctccccggtgaccaggtagatggtgtgctcgctgatgttcaccgcgtggtcggcgtaccgctcgtagaaccggccgagcagcgcgccgtcgatcgcggtctccgccccgtacggccagtcgtcggccagcatgatcttgaaaagctgccgctccaggtcgtcgatcgcgtcgtcgtccttctccagctcggccgcgaggccggcgtcgctgtgcgtcagcacggtggtgatcttctcggccatctggtcggcgatctcggccatgcccttgaagaccgggcgcagctcggccggcacggccggcgacgggtgccgccgggcggcggtcttggccacgtgctcggccaggtcgcccatccgctccaggtcggcggagatgtgcagggcggtgatcgcccggcgcaggtcgatcgcgaccggcgcctggcggacgatgatgtccgccaccttcgcctcgacctgctggaagatcgcgtccacgtcggcgtcccgcttgatgacggcctcggccgcctgcaggtcggcggtgagcagcgcggtcgtcgccttgcgaagcgcctcgcgcaccgactctgccatggtcaccaaaagccggttcacctcggtgagttcggcctggaactcctcgcgcatgttttaaagtcccgattgtcggggccgccccgcctcccgtgacggccgatgtgtgcagactccaagctaggtcagccgcgcggcccggacatgaacgccggtgaacgacgccaggcccggcggtgaacattgttcgacgcgcgcccgtttcgcccctttggccttgtgggccaggtaaacaatgaccctacgatcgctgcgtggattggggatacgccgtcggctcggtctcagccgcgctggccgtcggtgtcggtgctgggctggccctcgcccgtgtccggcaaccgtcgccggtcgacgtggcccgggacggctcaccggaggggagagccgccatcgaaccggacgacgatcgcccggcgggtaagcacggcctgaaagggctgggccgcaagagtctcgactcgctccgggtgggagtcgtggtgctcgacgcggacgactatccggtgctggtcaacccggccgcccgggcgatgggcctgctgcgctccggcggggcgccgggcaccatcgcggcccatccgatcctgcgcactctggccggccaggtgcgccggacgggcgtacgccgggaagtcgaacttgatcttccgcggggccgggccggtggggcgcaggccccgctcgggctgcacctgcgggccgtggcgctgaacgcgtcgcacgtcgcggtcgaggcggccgacgtgaccgagtcgcaccggctggcccgggttcggcgggatttcgtggcgaacgtcagccacgagctgaagacgccgatcggcgcgctgcagctgctggccgaggccctgctggacgccacccagctgcccgagaccgcacccggggcgcagtccgaggacctgcaggccgcgcgccggttcgccgagcggatccaccacgagtcggcccggatgggccggctggtgagcgagctgctggagctgagccggctgcagggcgccgagccgctgcccacccccgaaccggtgtcgctggactgggtgatcgccgaggtgctggaccgcacccggaccacctcctcggcgaagagcatcgaggtcaccagctccgggccgaagggcctgatggcgtacggcagcgacagccagttcgccaccgcggtgaccaacctggtggagaacgccatcgcctactccggcccggacaccagggtcgaggtgaccgtccggcaggagtcggagtggatcgagatcgacgtccgcgaccagggcatcggcatctccccccaggacgtggaccggatcttcgaaaggttctaccgagccgatcaggcccggtcccgggcgaccggcgggaccggcctcggcctcgccatcgtcaagcacatcgccaccaaccacggtggccgtgtggacgtgaccagcgccctcggcgagggctcgacgttcaccctgcgcctaccggcgcgcccgcccgaatccccctcgctgtcaccgacggcaactgagatctagtccggggtgaccgggtgtcgacccggtcaccgacgacggaaggaactgcattggcccgcgtgctcgtggtcgaggacgaggagtcgttctccgacgccctgtcgtacatgctgcgcaaggagggcttcgaggtgtcggtcgccgcgaccggaacctctgctctcacgcagttcgaccggaccggtgccgacatcgtcctgctcgacctcatgctgcccgagatgtccggcaccgaggtgtgccggcagctgcggcagcggtcagccgtcccgatcatcatggtcaccgcccgggacagcgagatcgacaaggtggtcggcctggagatcggcgccgacgactacgtcaccaagccgtactcgccgcgtgaactggtcgcccggatccgcgccgtgctgcgccggcagagcggtgaggccatcgaggtgagcactccgacgctggccgccggcccggtccggatggatgtcgagcggcacgtcgtcaccgtcgacggctccggcgtgcagctgccgctgaaggagttcgagctgctcgaactgctgctgcgcaacgccggccgggtgctgacccgggggcagctgatcgaccgggtctggggcgccgactacgtcggtgacaccaagaccctggacgtccacgtcaagcgcctgcgctccaaggtcgagccggagcccggcgccccgcgctacatcgtcacggtccgcggcctgggctacaagttcgagccgtaacatggcctcgctccgctcggcgggcattccgcccgtcgatgatgggagcaccgaaagacaactgcgcttcgctggctgttttccggcactctcgtcatcgacgggcgaaatgcggggtggctatgcggaccggggggaggcgggttcgcgcccgcctttgcgcttcggccccccggccgcggtggtcgccgggtggacggcgagcaggccggtggccaggcgggcggcgcagagctcggcgagtctccggtaggccggctcgccgatcagctcggtgagctccgggccgtaggacacgtacatcggctcggtgccgacgtgcgcctccggtgacgacgtgcaccaccaggccagatcgtgcccgcccggcccccagccgcgccggtcgaattcggtcagcgtcgactgcagcagtttcgtgccatccggtcgggtgatccagtcctgctcgcggcggaccggcagctgccaacagacgtccggtttgtacttcagcgggtgctcgccgtcccgcagcgcctgggcgtgcagcgcgcagccgcccccgccggcgaagtccgcgtcgttgaggaacacgcacggcccgtcaccggatcgggtggcggtgcgccgggccggcttggtgccgtccacggtgtccatctcggtccagttcttgaacccgcgccggtggtgctgccaggtctgcggggtgagtttcgcggccgccgccttcacccggttctcgtcgtcggcgtcggtgaagaacgcaccgtgcgagcagcagccatcctcggcgcgaccgggcagaatgccgtggcaggcggagccgaagacgcaggtccagcgggacagcagccaggtcaggtcggcgcggatcaggtgctgctggtcggcggggtcgaggaactcgatccattcccgagggaagtcgagtttcacttccacggggcgtcgtgcgcggctcatcccgcacagactacgcggcgccggtgatcatgcccgtttggcgcggatatatcccgcgctgcggggcgtggttaggcttgaggcgtgacttcccgagttcccgtgctcctctccagctcctcggtcttccccgagccgacggcggccgcgttcgagatggcggccacggtgggctacgacgggctcgaggtcatggtgtggaccgacgccgtcagtcaggacgccggtgcactcaagggcctctccgaccactacggtgtgccggtcctctcggtgcacgccccgtgtctgctggtcacccagcgggtgtggagccccgacccgtgggagcggctcacccgggccgcgcagctcgccgagtcgctgggcgcccccacggtcgtggtgcacccgccgttcacctggcagcgtgactacgcgaagaatttcgcggccggcctggccagggtctgcgaccggcacccggatctgaccttcgcggtggagaacatgttcccggtcaagatggccggccgctggttcgtgccgtacacgccgggctgggatccgaccgagaccggcttcgacgcgtacacgctggatctctcgcactgcgccgcctcgcggatcgactcgctggacatggcggcgaagatgggcagtgctctccggcacgtgcatctgggcgacggcaccggtgcggggcgggacgagcatctggtgccgggccgcggcaaccaaccctgcgctgagctgctgcgatcgctggcgggtcgcggtttcaccggctcggtggcctgcgagatcaacacccgcaaggccgcgagccgaaccgtccgcgaggcggatctccgcgagtcgctggaattcgcccgacgtcatctcgcgccggcggattcgtcccggccggcgctccaagcctgaagatcgacttctcggagcggatgtcgtgcgctgcggccgatgactgatcgccgctcccgccgcttccgggcacggcgattccggccgctgcgcgtccaggacgaatcgccgcaccctacgacccgcgggtggtcaccgcaggcgcactgcccgcgggtgccgccggagcctcggccgcgggatcaggccggtgtcagcgtcgcggtgctctccggtgtctgagcagctcgcttgcgggcgcggtgggcggccacgtgggagcgggtggcgcagcgctcggagcagaagcgtcgacagttgttcgaggacgtgtcgaggtagacgttgccgcagcgttcgtcggcgcagatgccgaaccgggcactgccgtattcacacagccagaccgcgagcccccagacggcgccggccaggtattccgcgctcaccgacgacccgcggctggtcacgtgcatgtgccagtccccggcgtcgtgcccggagatccgcggctgcaccgggtatgcctcgagcagcgtgttcagctcgcgcaccgcgtccgcgtcgcgctcggccgtgccgtactcgaagacctcgcgcagccggcgctgggcccggcggaagaccgccaggtccttctccacgacctgatcgcgcatgtattccaggtcgccggcgaacagggcccgcagcccggcgagatcgtccaggccggcgttgacgaggtcgaccgccgtccgggcgtacgcatcgaagttcacccgaccacggtagccgcaacccgccgcgaggtgcgattcctcaaccgcacttccgcgctggtgcggttacgctcggcgcatgttccgttccctgtttctcgccgcggccggctccgcccggctggcgcgcctggtcgagtccaccccggtcagcgcatcgatggttcggcggttcgtcgccggccgggacgccggcgaggtggtgcggacgagccgggggctggccgacgacgggctggcggtctccgtggacttcctcggcgaccagccggacacgccggagctggcgcgggccgtccgggacgagtacgtgtcgctgctggcccggctgggcgaggccggtctggccccggtcgccgaggtgagtgtgaagttgtcggcgctgggccggcgtttcgacgagaaggcggcgttcgagcacgcccgggcgatctgtgtggcggcggccgcggcgggcaccgcggtgaccttcgacgccgaggatcacggcagcaccgacgcgaccctggaggcggtgctggagctgcgacgcgacttcccgtcgaccggggcggtgctgcaggcgtatctgcggcgcaccgaggccgactgccgcgagctggcgaccgccgggtcccgggtgcggctctgcaagggggcgtacacggagcccgagtcggtggccttcccgtcgccgctggaggtcgacaaggcgtacgtccgctgcttgaacatcctgatgtcgggggccggctatccgatggtggcgacccatgacccgcgcctgatcgcgatcgccgaggaccgggcccgctggttcgaccgctcgaccggggagtacgagttccagctgctgttcgggatgcgcccggaggagcaggcccggctggccgacgacgggcacacggtgcgggtctatctgccgtacgggccgcagtggtacgcctacctgctgcgccgcctggtcgagcgcccggcgttcctggtagcggcggtttcctcccggaagtgattctttcgggcgaatcgctcacggatcaggcgtgtcggacttgactttttgtgggcaaattacggaacgcgacgccctggtcacagccgcatcgatacggtgctgatgacacgcacgttcgccaggcggagcgtgcctgcgaaaggatcggtgcgacgagatgacgggtccagcccagaccgaggaacgcctctcggaggtacggttcctgaccgtggccgaggtggccacgctcatgcgggtctccaagatgaccgtctaccggctcgtgcacggcggtgacctcaccgccgtccgagtcggccgctcgttccgggtgcccgagcacgcggtacacgagtatctacgaggcgcgttctcccaaaccgcctaatcagggctggccctgccggggtcgtgttggccctcacggagcgggccggtacgctggaccggttggctcccgggtccatgcgtgccgcgtaacaccggcggtgcttcccgggcgccgtccaagatcggtaccggccgggccggttccactcaaacatggttcgagaggctttcgtatgggctccgtggtcaagaagcgccgcaagcgtatggcgaagaagaagcaccgcaagctgctgcgcaagacccgcgtccagcgtcgccgtttgggcaagtgacggccggccgggtgcactgcccggccttcgccgtcccttgccgggacagttccgaggctcagcatcgaaaggtgcgctcgtggtgacctcaccgcccagcgttgtcgtggtcaccggagtcagccgatacctcggcgctcgggtggccgcccgcctcgcggcagatccacggatcgaccgtgtcgtcggtctggacccgcatgacccgcccgcacgcctgcgtggcctgctggacgggatcgagctgatccaggccgacgcgcgcgccgccaccgaggcgatcgccgagctcggcgccgaggcggtcgtgcacctcgcggtgaccagcgtgcccgatccggagcacggcggccgcgcgggcatgaaagagcacaacgtgatcggcaccatgcaggtgctggccgcggctcagggcgcgccccggctgcgcaagctcgtggtgcgctcgtccaccgcggcgtacggcgcgtcgttccgcgaccccgcggtcttcaccgaggacaccgagccccgcgccgtgccgcgcggcccgttcgcccgcgacatcctcgacatcgaggggtacgtgcgcggtttccgccgccgccggcccgaggtcgccgccacggtgctgcgcttcgccccgatgatcagctcgtccgccgagacgtcgctgacccgatacttcgcccagccggtggtgcccaccgtgttcggccgggacgcccgcctccagttcgtccacgtggacgacgcactcgaggtgctgcaccgctcggtgatcgaggatcatccgggcaccttcaacgtcgccggctccggtgtcctgatgctgtcccaggcggtccgccgggccggccggatcgccgtgccgctacccgagaccgggctgtccaccgccgccgcgctggtccgccgcctcggcgtcgagcagatcggcctggaccagatcgacctgttcgtgcacggccgggtggtcgacaccggccggctggtccgcgagttcggcttcaccccgcgcagcaccgcgaccgcgttcgaggagttcatccgggcgcacgcggcgggctcctcgctgaccgcggaccgtctggccgccgccgaggcggcgatcctggacggcgtccgtcagctgcgcgccgcggccgggagtgaccgctgatgagccaggacgagttccgcgacatgctgcccgggcacgccgatttccggctgccggagccgccgccggtgcgcaaggtgaacggccggcgtccgatcccggagaagccggacgagcaggtcgccaagctggagtcgaccgccgagccccggcccgacgacgccggatccgccgccgagccggccgccccggtcgacgtgtgggatcagcggatcgccgccgggctcgccttcctgcgccgccggctggccggggcgtacgaggtggacgagttcgggttcgatccggagctgaccgaggcggtcttccacccgatgctgcgggtgctctatcgcgactggttccgcaccgaggtgttcggcgccgagaacgtgccggtcgacggcggtggcctggtggtcggcaaccattcgggcacgctggcgctggacgcgctgatgctcacggttgccctgcgggacagcccgcagcgtcgccatctgcggctgctcggcgccgatctggtgttccggatgcccgggctcagcgacctggcccgtgcggccggcgccacggtcgcctgcaacccggatgccgagcggttgatgaccggcggccagctggtcggcgtgttcccggagggcttcaaggggatcggcaagcgtttcgccgaccggtacaagctgcagcgtttcggccgtggcgggttcgtttcggcggcgctgcgcaccggcaccccgatcatcccggtcgcgatcgtcggcgccgaggagatctatccgatcttggccgacctgaagccgctggcccggctgctcggtgtgccgtatttcccggtcaccccgaccttcccgctgctcggcccgctgggtctgatcccgctgccgagcaagtggctgatccagttctgcgagccgatcccgaccgcgcatctgaccgagttcgcggacgatccactggtcgtctacaacctggctgaccaggtgcgggagacgattcaggcgaccctgcacgagctgctgcagaaaaggcccgatccgttcgcccggtgacgagccgcgcgaaccgtcctatagtgacaattgaggggcggccccggatttctccggcaccgcccctcgccagcttcggctcagaacacgttgcccagcagcccgccgagcgtgccctcgtcgccggattcgtgaccgtcgtcgagggtgggcgtcccggccggcgtcgggctggtcgtcgtgcgcccgttcaccggcgtggacggtgtcaggccggaccggtgcccgggcacgccggtgctggcgcccggttgcgccgaggagccgggcacgaccggcttggtggtcgtgttgttcggcttgctcgtcgacctgtcgccaccggcgcgggtgccgccgggcggcgtcttgtcggacgggtcctcgccgcagtcacgcagtttcggcccgagcccgtcggcgccggtctgcaccaccttttcgcagtccaggccctcgcggagctggccggtgcgctgcgagacgtcctgcagcaggccgagcgaggtgagcgcccgctcccggttgaccgacgagaggttctgcatggccggctcgaacaccttgcgctgtgcggcgacgaacgtgtccagggtggccagctgggccgggtccttgcgggacaccgccgaggtggtgatcagcttgacgcctttgcgggtgtccgcgtccatgtcgtccagcacgccccggaagctgtcggcgtccccggtcatcgtggtcgcctcgcgcagccggttgcgggcgaagtccagcgacagctgcccgcggctggcatccgagccggcgatcgccagctgcgcgcgttcggtggaccgcttgacgccgtacagcgcgtcgcccggtgtcgcgttctcgctggccgcggagatcccggagaccgccatcgcgccggcggcgacgccgagcacgatcgccccccgggtgcgcagccggcgcccgaagatggcgcgatgcccgcgggcgggcagctcggtggccggttccggctcggcctcggcggcggtccggccgatgccgtcccgctcggccgtggcgaccagcatggcgcgcagcccgacccggaactccgggtcgacctgcccggccggccgggcggcggacagacgtcggctcagcgccagcagttcggtcagctcgtcatcggcgtgaccccgcaggtggcgatggtcgccaccggggtcgtcgacctgctccgcgaagcgctcggcgctccgggagctcggaaaagggaacttcaccgtgggcacctcccctcgctcgtgagtgtcccgccggtccgtgcgccggcgtcggcgaccgggccgccggaggcagccgtgggtcgcatccggacaaacgcgcgacacgcgggtccggttacgggtgtggagggggaccatcgggtatcggagatcgatgtccgatatcgcccgatcaagactggaatccttccggcagcagccggttgagcgctcggaccgcgcggtactgcagggccttgatcgccccctcgttcttgcccatcgtctgcgcggtctcggccaccgagaagccctgcaggaagcgcagcacgatgcactcctgctgttccgggttgagctgtttgaccgcggtgagcagggcgacgttggtgatgtggtcgaccaccgcggactccgggctgccttccgggccccgatcctcgcggtcggcgtcgagcacgtcgccggtggtcacctcgagccggtaccggcccgacttgaagtggtcggcgaccaggttgcgggcgatggtgaccagccaggcgcccaggtcgcggccctgccaggtgaaactgccgatccgcttgagggcgcgcaggaaggtgtccgaggtgaggtcctcggccagctgccggttgccgacccggaagtagacgaaccggaagaccgtgtccacgtaccggtcgtagatcaggccgaacgcctcggcctcgccggcctgggcccgctcgaccagcgcccacacctcggctgccgggtcgccccggtccggccgggccttgggcggctgggtctcggtcggcggcccggtcttgctctgggtgggcagcacgacggtgtggtcggtgccgggggtctcgctctccggcaggttggagcgctggccggcggtcggctgggccggtggccgggcgccgagccggttgccgccgaacttgccgttggcgccgggcgccggcacggacggtgagttgttcagcgggcggcggttgccggtgcggcgggggctgtccccccggatcgcgttggtgatcatgccgtcgaccgattcgcggatcacgttcaggccgtcggtgatcgcctgcctcccggcgaggacatcgcggtggtacgggccctcggcgtacacatgagtcactgcgcctcctcaacccggcgggcctgcggcgaccgtgaatccgtcccgccagacagggattcacggcgattccgtccttggtgtggcacagcggcctcctcgggatgagggtggtcactcgcatacaaaaggggtggggcaacccgcggaaatcgccggtaacctcacccgttcgtgtggagtccgttacacagatcggaagtatcaccgagttcggacacagggagtcgcacaccatgtgcgctacgcgcaaagccgcgaatccgtccgaaatcggcatccggtatcaaggtcaccctggtccatcccggacgccgggcaacggaccggctgtccgctatcccggacgggtgacgtttgtgcgagactcgggcgtcgtggaggaacccgcccgcgatccggtcgcgcacgccgccgcccgccgcccggactcgcccgcgctgatcgccggggaaaccgtgctgacctgggcggatctcgacgtcaaggtgaccgcggcggcccgcttcgtggccgcgcgcacggcgccgggcgaccgtgtcgcatccgtgctcggcaataccgtcgacttcgtggtcacctggttcggcaccctgcgggccggccgggtcgccgtgccgttcaatccgggctgcacggtggacgaggcgacgcatgcactctccgacgccggttgtgcgctgatcgtgatcggacaggcggatcggttacgcctcggtctgggcgagtcgtgcgtcggtccggatttcgacaatgccccggcggccgagcttccgccggtggccgcgagcgatctcgcggcgctgctctacacctcgggtacgggtgggcggccgaaagccgccatgctgacccacgccgcgctcgccgcgaaccatgaccagctggacgcgatcgagccgccggtggtcgggccggacgacgtggtgctgctcgcggtgccgttcttccacgcctacggactgaacaccgggctgggcagcgtggcgcaccacgcggcgaccggcgtgctggccgagcggttcgacccggcggagacggccgccctgatcgcgcggcaccgggtcaccgtggtggtcggcgtgcccgggatgtatcaggcctgggtgcgggtgcccggcgctctggaggcgctggccggcctgcgaaccgcggtgtgcggcgcggcgccgctggaccgggccaccgcggcgcggttccgggcggtcaccggccggagcatcatgatcgggtacgggttgaccgagtccgcaccggtgctgaccaccacggcggtcagcgaccgggacaagaccggctcgatcgggcgccccctgccgggggtcgagctcatccttcgtacccgggccggtctcgaactctggcgggacggcagtgcgtcgccggaagaggatctcgccgagctcgacctcgcgccggccgtgtcggccgggaccgatccgggcgagatcgtggtgcggggcccgaacctgttcgccggttactggcccgacggtcgggacgggccggacgcggccggctggtggcccaccggtgacgtggcgtacgcggacggcgacggcgacctgatcctggtcgaccggatcggcgagctgatcctggtgaacggcttcaacgtctaccccgccgagatcgagcgggtgctgcacgcgcatccccgggtgaccgaggccgccgtggtcggccggccggaccgggagaccggccagcggccgcacgcgtacgtggtggtcgccggcgacccgccgccctcggtgaccgatctgcaggtgcactgcgcggtccggctggcaaggtacaaactgccgaccatcgagctggtcggcacgctgccgcggtcggccagcggcaaggtccgcaagagggagttgtcttgacccgcatcacgctgatcagccggggcggatgccacctgtgcgaggtggccgagcagacgctggaccggatcgcgccgggggactggacccgggtggacgtcgactcgtccgtcgagctgcagcgcgactacgacgaccgggtgccggtgatcctgctcgacggccgggagcacgggtactggcgggtcgaggaggcccggctgctgcgggatttggctcgacagcccggcgagccgcacctgtaaattgccggggtgacagcaaagcacctggtctgggactggaacggaacccttctcgacgatctccacctggtcgtctcgtcgaccaacgaggcgttcgccacggtcggcgggcgggcggtcggcgcggacgagcaccggcggctcttccggcgcccggtcgcggagttctacgccgagatgctcggccgggcggtcgaggccgaggagttcggccggctcgaccggatcttccacgacgcgtaccggctcggtctgaccgatgtcggcctggccgccgacgcgctggccgcgatcaagagctggcccggcagccagtcgctgctctccatgtggttccacagcgagctggtgccggccgtcgagacgtacgggctggccgggatcttcacccggatcgacgggctgcgcaccgaggtgggcggcgacctgaaggccgggctcctggcgcggcacctggacgggctgggcgtggccggtgccgacgtggtgctgatcggcgactcgctcgacgacgcggccgcggcggactcggtgggcgccgcctcggtgctgtacaccgggggcttcaccgacccggtccggctgcgcgagtccgggcggccggtcgcggactcgctcgtcgacgcggtgaagatggctttgtcactctgagtcgattggccctggtggggtatcaccggtaatactcgacaggtcggctcggttaacacagtcgagtcgatcttgtccaattgtcccgacaagatcgcgatttgtgcacgccttcacaagcgcctactctgtggcttcgacgagccccgctaccacagtcaccccacgagggtctcaccggtatcgcacagaacgggctcaccgcaggttcgcctcgtcggcacggagtcagatgagtcagcagcgtcacggaagcacgcccggcgaggccggtggcgtcccggccttcccggacctcccggaggcgaccatcgcgcggctgcccgaatatctgcgcgccctccatcatctggccgaggccggtgccgaaacggtatccagcgagggtctggccgccgcagccggggtcaactcggcgaaactgcgcaaggacctctcccatctgggctcgtacggcacccgcggcgtcggctacgacgtcgccctgctcgtcgaccagatcgagtacatcctcggtctggacaagaaccgcgccgtctgcctggtcggggtcggcaacctcgggcacgccctggccggctacgccgggttcgccagccgtggcttccgggtcgtggcgctcttcgacgccgaccgcaagaaggtcggcgaggtgatcaacggcatggccgtgcgccacatcgacgacctggcccggctcgccgccgaggagtcgatcgcgatcggggtcatcgccaccccgcccaccgccgcgcagaccgtcgccgacctgctggtcgccgccggtgtgacaagcatcctgaacttcgcgccatgcgtgctgtcggtcccgccgaacgtcgatgtgcgcaaggtggatctcgccatcgagttgcagatcctctcgttccacgaacaccgtaaggcgtccctgaccgcccttcccggaggcggggaacccgcgggtgaccaggaggcagtcgggtcgtgaatctcctcagcatcggtgcgtcctaccgcaccgccgacgtttccgtccttgaacggctcaccatcgcttcggcccagatcccggagatcctgcagaaactcgtcgcccagccgtacgtgagcgaggccgtgctggtctccacctgcaaccgcgtcgaggtgtacgccgcggtcagcgggttccacggcggcctcggcgacatctgcaacgtgctctcccagacctccggcatcccggccaccgagctggccggccacctgtacgtgcactacggcgaggccgcggtccggcactcgttccgggtctcctccgggctcgagtcgatggtggtcggcgaggcgcagatcctcgggcagctgcgtgacgcctaccacgcggccaccgagtcggactcggccggccggctgctgcacgagctgatgcagcaggcgctgcgggtcggcaagcgggcgcacgccgagaccggcatcgacaaggccggccagagcgtcgtcacggccgccctggaggtggccgccgaccacctcggcgggccgctcgccgggcggtccgcgttggtcgtcggggccggcgcgatgggctcgctgtcggtggccacgctcacccggaccggggtcggcccgctgcggatcaccaaccgcagcgcgtcgcgcgccgaccggctggccgagctgtacggcgccaccgcggtgccgctgtccgccctgcacgacgagctgcgcacggtcgacctggtggtcagcgccaccgcgtccaccgagccgctgctcacccgggacgtgctcagcgccgccctggccgcccgcacccaggccgacccgctggtcgtgctcgacctcgccgtgccgcgcgacgtggccccggacgcggccggtctgcccggcctgttcgtggtcgacatcgactcgctggccaccagccggcggtccgccccggccgccgccgagaccgccgcggtcgagcagatcgtcagcggcgaggtggacaacttcctcggctggatgcgcggcgccgaggtcgcgccgaccgtggccgccctgcgcacccgggcggaggaggtggtcaccgccgagatgcgcaggctcctcggccggcggccggaattcaccgaggagcagcgggccgacgtttcccgtacattgcaccgggtcgtccagcagatcctgcaccagcccacggtgcgggtgcggcagctggccgccgagccgggcggcgatcagtacgccgccctgctgcgcgagctgttcgacctggacgtccccctggccacccacgccgacgcggtacccgagatcggaggaaaaccgtgaccagtgtcaagccgctgcgcctcggtactcggggcagcaagctcgcgctcacccagtcgcagatggtcgccgacgagctgaccctggccaccggccgggccgtcgagctggtccggatcgtcacgcccggtgacacctcgtccgcgccggtcgcccagctcggggtcggcgtgttcgtctcggcgctgcgggacgcgctggtggccggcgagatcgacttcgccgtccactcgtacaaggacctgcccaccgccgagcacccgcggctgacgatcccggcgattccccgccgggaggacccgcacgacgtcctggtcgcccgggacggccgcggcctggccgacctgccgcccggctcactggtcggcaccggggccgtgcggcgcatcgcccagcttcgcgcgctcggcctggagttgcaggtcacgccgatccggggcaacatcgacacccgcatcgcgcgggttctcggcccggacgccgacctcgacgcggtgatcctggcccgggccggcatcgcccggatcggccggaccgccgacatcacccagacgctggacccgatgctcatgctgcccgcccccgcccagggtgcgctggcggtcgagtgccggtccggcgacgctgacctggtcgagctgctggccacgctcgaccacgcaccgacccgggccgccgtcgtggcggaacgggcgctgctggccacgctggaggccgggtgtgccgccccggtcgccgcatatgcccgcctcgtccggggcaggcatgccggctcggcccccgaggacgggcgcggcgaggagatgattcacctgcgcggtgcggtgatcagcccggatggggttcgagccatccggctgtcgcgcaccggaacgcccgccggggcggcggagatcggcaaggcactcgccgccgatctcctcgacgccggcgccgataccctgatggggagcacagaatgaccacccgcaccgcccgtaagccagccggacgcatcgcgttcatcggcgccggacccggcgacccggagctgcttacccgccgcgcgtacgccgcgttgaccgatgccgaccaggtggtccacgaccggggcgtacccgagtcgctgctggccgcggtccgcgcggacgccaaacccgacgcgcagttcagcccggccgagggcgcccccggcgacgtggccaaggtgctgctctccgccgccaagtccgggctgtccgccgtccacctggtggccggcgacccgttcggccacgagtcggtggtcaaggaggtgcaggcggtcgcccggaccgcggtgcacttcgaggtgatcccgggcatcgggcaggccgagggtgtcgccgcgtacgccggcgtgccgctgcccggcgtgcggatcgccgccgacgtcgacgacgtcacctcgctcgacttcgacgcgctggccggcgcggcccagaagggctcgttcgcggtcgccgtggacgccggcgacctcgccgcggtccgcgacgggctgctcgcggccggcgtcgaaccgggtgtcccggtcgcggtgaccggcgacggcaccggcgagacgcagtacaccaccacctcgacggtggacagcttcgtggccgccgcgctcggcttcaccggccgggtggtgctcaccgtcggggccgaggtcgccgagcgggacgcgatgagctggtgggagaaccgcccgctgtacggctggaaggtcctggtcccgcggaccaaggagcaggccggcgcgatgagcgcgcggctgcgggcgtacggcgccatcccgtgcgaggtgccgaccatcgcggtcgagccgccgcgcaccccggcgcagatggagcgcgcggtcaagggcctggtcgacggccgctacgcctgggtggtgttcacctcggtgaacgccgtccgcgcggtctgggagaaattcgccgagcacggcctcgacgcccgtcacttcggcggtgtgaagatcgcctgcatcggggaggccaccgccgaggcggtccgcgacttcggcatccagcccgagctgatcccggccggcgagcagtccagcgagggcctgctggccgagttctcgccgcacgacgagatcctcgacccggtcggccgggtgctgctgccgcgcgccgacatcgccaccgagaccctggccgccggcctgatcgagcggggctgggaggtggacgacgtgaccgcgtaccggacggtgcgggccgcgccgccgccggccgagatccgcgacgcgatcaagtccgggggcttcgacgcggtgctgttcacctcgtcctccacggtccgcaacctggtcggcatcgccggcaagccgcacgcccgcacggtcgtcgcggtgatcgggccgaaaaccgcggagaccgcggtcgagttcggcctgcgggtcgacacccagccgcagaacgcctcggtgccggacctggtcgaggcgctcgccgaatacgccctggagctgcgcgagaaactggcggcgatgcccgccaagcagcgccgcggctcgaaggtgcagggcccgacggccctccgattccgctgatgtggtgacaagcgcgccggggatgtcccccggcgcgctttcgtttttagggagctccgatgtccttccccgacatccgcccgcgccggctgcggcgcaccccggccatccgccgcctggtcgcggagacccggctcgcgccctccgagctgatcctgccgctgttcctcaaggacggcatcaacgagccgaaaccgatcagttcgctccccggcgtcgtgcaacacagccgggagtcgctgctgaaggccgcccacgaggcggtcagcgccggcgtcggcggcctgatgctcttcggcgtgccggacaacgccgacaaggacgagaccggtgcggccggactcgacccggacggcatcctcaacgtcggcctgcgcgacctgcgggccgagttcggcgacgccacggtgatcatgggcgacctctgcctcgacgagttcacctcgcacgggcactgcggggtgctggccccggacggttcggtcgacaacgacgccacgctggagatctacggccggatggcggtcgcccaggccgaggccggcgcccacatggtcggcccgtccgggatgatggacggccagatcggggtggtccgcagggccctggacgcggccgggcaccaggacgtctcgatcctggcgtactcggccaagtacgcgggcgcgttctacggcccgttccgggaggccgtggagtccaccctgcagggcgaccggcggcagtaccagcaggacccgccgaacctgcgggaggcgctgcgcgaggtcgacctcgacgtcgccgagggcgcggacatcgtgatggtgaagccggcgctgccctacctcgacgtgatcgccgcgatccgtgagcgggtcaccgtcccggtcgccgcgtaccaggtctccggggagtactcgatggtcgaggcggccgccgccaacggctggatcgaccgcgaacgcaccatcctggaaaccctcacctcgatcaagcgcgccggcgcccagatcaccctcacctactgggccaccgaggtcgcgaagatgttgcgatgaggcagcagggcaaaatcaggttcaaaggcatatatacgcaggtccgccggggtgcagaccgtatgctcccgcgcgggccgaggccggcgatctggccgctgcgcgtccagagcgatcgccgccctctaatgagtgctaggagctgccggatccggcaagcttctggtgggtaggtagccgccggcggatgagcactgacgtcctctgaacgtgggagttcttagtgaagaccgtgccgccgccggtcggctgggagaacagaatcgctgatgggatgtcgtgcctttgagcactggttcattaggtcgctgatggttctcctgccggctgcaggcccgcgtcgttgctggtcgtggacgggagagcgtgttgctgttcgtgggtgatgactgggccgaggaccatcacgacgtcgagttgatggatggttcggggcggcggctggccaaggcgcggttgccggagggtgtggcgggtatcgcccggctgcacgcgatgatcggcgagcatctcggcgaggccgacagtgagtcggcgcaggtcaagatcgggattgagaccgatcgagggctgtgggtgcaggcgttgatcgccgcgggctacacggtgttcgcggtgaatccgttgcaggcctcgcggtatcgggaacgcctcgcggtgtccggggccaagagtgacgccgcggacgcgcacatgctggccgacatggtccgcaccgactcgcaccagctgcgtgcgatggccggggacagcccggacgccgaggcgatcaaggtcgtctcccggatgcacaaaaccatgatctgggaacgtgaccgggcggtgctacggctgcggcacgcgctgcgcgactatttcccggccgccctggccgcgttcgacgacctcgacgccgccgacagcctcgaactgctgggcaaggcgcccgagccggccgccgcggcccggctgagcctgactcagatcagcgccgccctcaaacgcgcccgccgccgcggtgacctcaccgccaaagccaccgcgatccagacggtgctacgcaccggacacctgggtcagccggccgtggtcgccaccgcctacgcggccacgactcgttcgctggtcgcgctgctgctgaccctcaacgagcagatcgccgtcctgcaacaggaggtcgaggcccattttggccggcacccggacgctgagatcatcctgtcccagccgggactcggtgctgttctcggcgcccgggtgcttgccgagttcggcgactaccacgcccgctacgccagcgcgaaagcccgcaagaactacgccgcgaccagcccgctcacccgcgcctccggcaagaaaaagatcgtcatggcccgctaggtgcacaacgaccggctcgccgacgccctgcagggccaagccttcaccgcgctacgcgcctcacccggcgcccgcgcctactacgacaggcaacgcacccgcggcatcggccaccgacccgccctgcgacaactcgccaaccgcctcgtcggcatcctccacggatgcctcaaaaccagcaccccctacaacgaaaccaccgcctgggcacaccacctcgaccaagccgcttgacacccctggcacatgggatgtcttcactgtccgcggtcggtcaccgaaaccccacttcattgatcggcaggtcccaggcggcggaccaggtcgccgacgtcggcgatgtattcgtaccagtcacggtcggactggtagcccagctcggcgttgaccttgagcatggattcgttgtgctgcgcgttccaggtctggacctggcgcaggcctgactcggcggcgcgcagctcgaacagcatccgggccttgatggcgcggtcgatgccgtagccgcggtgctcgcgcaccacgatcgtgtcgtactggtcggcgcgctccgggtgctgggccgggacgaccacctcggtcagcccggcgaccgagccggtcgactcgtggatggccagcacgatgtacggcttgaggccgcgccggtgcagcgtgtcgagagactcgcggagccgctccggatccgaggagcggggcgtcaggtccagatcgtcgtcgtcggtctgggcctgcgccttggccctcgcatacgcctcgagcagcggggcgggcgggccgcccgggtgatactccacccggtagccgctgctgatgccgctggccatggtgcccagcgtggcccagtcgacggtgtccagactcaggacggaacgggtctccacatactcccgctcgaaacccagcgactcgtagaaggcgatcgccggggtgccgccgatcgcctccaccccgatcgaggagaaaccctccaggtacgcccggcgggcggccaccccgagcagttcccggcccagcccgcggcggcgcaactgcggcttgaccaggatttcgagcacgccgatgtcgcccagcagcagaatgctgaccagggcgtagatctcgctctccccctccgggagccgatcgtcctcagcgacccagcagatccgccgctcgccgggcatggtctcggcgagatagtccctgacctgcacgtcccgccagggtggatcgtcggggaggtcggtcgccagcaccgcgttgaccgtctccaccagggagtggacctcggccgcggacgcggagcggggatcccattcacgcaccctcacccgtacatcgtgccgtgcagcggactcacagggaagtgctgaccacgcaaaagtacgcatcccctcaccgagcgtcgccactccccgatgtcgcgtacccgcctgtcagcgcggcggcggcgtggaccggcagcgtcaggagcggctcttctggccgtactggttggcggcgtcgaagatcttctgagccgaggggcggagcgcgccgtagttcagcaccgcgtcccaccaggcatcggcccgggccaggttgcggatgctgccgtgggcgtccctgcacagcgacgaggcggcggccagcgcggcatcgtcgatgtcgttgatgtcggcgaccccgttgcggtcggcgtccaccgcgttcgcccgccaggcgctcgggatcatcttcatcgggccgacctcccggtcgaacgccggatcctggtcgatcgtgccctgatcggtgtcccggaccaggggccgcccgccctgcccgtccagcggcaggccgtagatcgtcggttgcgccaccccgtccaccccgaggaccgccccgttggcgctgccgtgcccggacgccaccttgccgatcgcggccagcgtcgtccagttcagccggcaggtcggcgtggtctgcgtggtgaccagttcggcatacccgtacgcctggacggccaccaccgggatgccgaccttgtccgcggtcgcctgtgcccagccggccagggcgtcggccggccgtgcgccggtgccgaccccgttgttgatcccggtcccggtgcccgggccggtgcccgtgcccaggccggtcccgaggcccggggtgccggtggtgggcaggccgaacccggtggccggcgcccccgggaagcccgggatgccggccgggggagcggagaacccgccgccggggatcccgtacgggtcgctggccgacggcgccggcaccgcacccgcaccaccgagcgccgcgctcgcactcggcgccggatcggcctccagcgcccgcgggaccagatagaccccggcggagccggccagaccgatcagcagcagagcgatgacgctcgggatgatcacgcgcccgctgggccgcctggcccacgcacccacggcacgcccaccgcggcccgccagcccgagcgatcgccgcaccagcccgcgccggcccgccgcggccgctcccgaagcagcggccgcgtcctttccctctgcagccttctccggcgtggccacgtcgccgcccgcggccttggcagccgcgtcagcggtcctgtccgtagctttgtcaccggcgccggcaccgctgtcggcaccggtgcccttcgattccgcctagctagctagctgctccggcatccggtccagccgttttgtccggcttgtcgccggtctcggcggcaccctccgcgtcggtacccttgtccgcgcggaccgatttgtccggaacggggatcgccgaagcggatgccgcaccggaaccggccagcgggccgccctgatgcggcgccgccgcccgcaactccggccgctctgctgggatcttcggtgcctccgccacgcgtccgaccctaccgggccgcgcccaccgccggggaaatcgccggcgccctgtggacaacctccgagcgaacgggctctacgctggcccgatgccgcgttatgactaccgctgccgcgcctgcggtgccaccttcgagctgaaccgtccgatgcgcgaggccggcgatccggccacctgtccgcatggccacggcgacacggtgaagctgctgtccactgtcgccgtcacgggccgtggcggcgccgctccggcgggcggcggcggtggcggctgctgtggcggcggttgcggctgctgaccccgaccggtcgaagtttccggtgaacgcgcgaccgcccctgaggaaacggtgtagtccgtaagagtgatctgcctcactccttacctcaaacccttcgataccgcccgtgcgaccacattgaccaccaaccacctgtccactatcacccaacgtaaggatcaccggacccttcgccgacaaatctgcccagctcacggccgttttcccgagtgatgagacaacacgtacgggtacatccgaacggtccggcggttttggccgactgcgtcgtttccgcgttcgatctctttcgttacgacacgcgtagtcccgtatgccgacgtcgatcccggatttgatgatgtcctccgtaaggggtcggccgtggcgggaacatggttaccgtccgtttctacgatgggcggtgactctgagatacgtcagcatgagtcgcgacttcccaaagggggcggaggttcaaccgtgtcgggacggctcgagctacccagtggcctcgtgacctttatgttcactgacatagaggggtctacacgactggcccggatgctcggtgacacctatcgcgctgtgctgaacgcacatcgctcagtgttacgtgcggcgctgagcgacttcggtggtgtggagctcctcaccgagggtgattcgttcttcgtggcgttcgacaacgccgacgccgctctggcggcctgtgtggaggcgcagcggcggctggccgcccatccctggccgcgggaggacgccgtgccgcgagtccggatgggactgcacaccggccgggccaccccgatcggcaccgagtacgccagcgccgaggtgcaccgggccgcccgggtcgccgccgccgcccacggtggccaggtgctctgttcggaggcgaccgcgctcgcggtcaccgccacctatgccacctcgggacacggccgggtcgcgacggcggccgcggcgacgctggccaccgtggacctgctcgacctgggcgcgttccggctgcggggcttcgacgacgccgagcggatcttccaggtggtcgcgccggggctggaccgggagttcccccgcccgcggaccgcggaggcgccgcggcacaatttgccggccgcgcacagctcgttcgtcgggcgccaggcggagtgcgccgagctggccgagctggtcggccggcaccggctggtcagcgtggtgggcccgggcggggccggcaagacacggctgagtctggccgtgggcgagcaggtggtcgacgcgtaccccggcggggtctggacgatcgacgcggtgagcgcggccggtggcctgcccgccgccctggtcgcggcgctggggctgcggccggagcccggccgccaggcgatcgagacggtgctggagcagtgcggcgagcgccggatgctggtcatcctgcagacctgtgacgccgcgccggggctgaccgcggcgctggcgcaccggctgctgtcccgctgcccgcggatggatgtgctgaccaccggccgggcgccgctgggcctggccggggagaccgtgtggcggatcccgccgatggccccggctgacgcgttcgccctgctcaaggagcgggccacggcggctcgtggcgggcggcgcagtgacgacgacaccgcgctggccgagctggccgcccggctggaaggttcgccgctggcgatcgagctggccgccgcccggctgcggctgttgccggccgaactgctggcccggcggctggacgatccgatcggtgcgctggacggggacgcctgcggcgagggccggcacgccagcctgcacaacaacctggaatggtcgtaccggagcctgggcagccgggccgccgagctgctgcatcggctggcggtcttcgccggcccggtcgatctggccaccgtcgactggtgcggcgagggcgctctcagcgcgctctccgagctggccgagaagtcgctgatcgaggtggtgccggggccgcgctaccggatgtccgggcacgtccggtcgtacgcgttgcgccgcctcgccgccaccggtgacgagacgtccgtgcgggatcggcatctggcctggtcgctggagatgctgtcggcggtggcggtggacaccgacgggcagccgcggaccgtgtcgctcaccgatctggggccgttcgtgccggagtggcaggccgcgctgcgctgggcggcccgctgcggggacgtgtccgccggcctgcgcctggccgcggcgctgagtccctggtggcgggagcacggcggggccggggaggggcgggacctgctcagccggctcggcgaacgggacggcgccgaagccgatccgacggagctggcccggtcgtacctgatccacgccgacctgaccggcgaccgcgcggagcgggacgacctcctgcggcgtgccgagcaggcggcccggcgggccggcaacgcggcgctgctggtccgggcgctgggcggccggcggatcccgctggacgagcgtgccgacgaggcggcggagagcggctgtcgtgcggtgatcgccgaggcggaacggaccggggtggtcaccgagtcgctgccggccgtgctggcgctggccgagctctactggcggcggggtgcgctgaccgaggcggccgagctgctcggcggcgcccggcagctggaggcgggccggccggaggaccgtggccggcgggccgtggactggctgctcggcatggtcgcgttgcgccggggtgacctggtggccgcgcacgatcacctggtggtggcgctgcgctcccggctgcggcacgggttccggggggcggccgcggacgcggtggcggcgatcgcggcccgctgcgcgctgggcggcgatccggtgaccgcgacggtgctgttcggcggagcggaggcggcgcgcggggcgcgccgcaccgagtcgttcgggagtttctggtccgagcggcaggccgcgttgcggctcgcgctgggcgatgccgctttcgatgccgcgtacgccgatggcgcgaacctgggtttcgatcggatcgtcgcgatggcgctggccgtcgagcatcccgacctggaggacggggcggcgcgcttcgcgcagatcgtgcggtagctcagccccggcggatcattcccggcaccgatgtgatgtgcatgtcagtcccggccgttagggtgtgttccgtgcaggcggttctgtgattcacctaccgatggtccgtcagggaccgctgaaagcgctggctgtccggctcgcgatggcgctcgcgctggtgctgagcgcggtggcggtcgtctatgccgaccggggcggttaccgcgacgtgaacggggacggcctgagcctcctcgactgtttctactacgcggtggtctcgctctccaccaccggttacggcgacatcaccccgtcgacgcagggcgcccggctggtgaacgtcctgttcatcacgcccgctcgggtgctcttcctgatcatcctggtcggtaccaccctggaagtgctgaccgaccagtaccgcaggggcctgcggatcagccggtggaggcggaagttgaaggaccacgtggtgatctgcgggtacggcaccaagggccgggccgcggtcgacgcgctgctggagaccggctacgacaagtcccgcatcgtgatcgtggagaaccgggaggccgccgtccggcaggccaccgcgaacggcttcgtggtgatcgagggcaacgccacccgctcctcggtgctgctcgaggcggacatcaagaactgcaagtcggtgatcatcgcgaccgatcaggacgaggcatcggtgctgatcacgctgaccgtgcggcagctgaccgcgggccaggtgcggatcattgcagcggtccgcgagcaggagaacgcggcgctgctcaagcagtccggcgcgcaccacgtgatcgtctcgtcgtccaccgcgggccggctgctgggcctgaccacgaccgcgccgccgttgatcgacgtggtggaggacctgctcacccccgggcaggggatggcgctggcgatgcgctcggcggagcgggccgaggtgggccgtaacccgcgggagctgccgacgctggtggtggcgctgatccggcggggcaaggtactgccgctcggcggggagcaggcggtcaccatcgagaccggcgacctgctggtctacatccgcgacgacgccagcaccgcggccggcgtcaccgtctgacttcggcgccggagcagggtggcggcaccgtctgaccgcggcgccggagcagggtggcggcaccgtctgaccgcggcgccggggaagaggcggccgcggtcggacggcgtacggcctagatgatggtccaggtgtcggcggcgttgaggagatcggcgagcatctcctcgggcgtgccggtggcctgggcctgagcgtcgatcagctgcttgcggacgatctcgtcgtaggacggccgccggacgtcccggaagacgccgatcggcgtggtgttcaggtcggagccggagagccgggtcagcgcgaacgcgtacgccgggtcctccaccgtcgcgtcgtgcacgatcggcgtgccgccctgctggacgcacaacccgaagctgccctcgggatggacgaccgagtagtcgccgaaggtgatcggctgtccctgttccagccggatcaggtgctcgtcccgggtgtccgcgtccttgatcaggtcgaacgcgccgtcgttgaagatgttgcagttctggtagatctcgacgaacgccgagccctcgtgcgcggccgcggcccgcagcaccgactgcaggtgcttgcggtccgagtcgatggtgcgcgccacgaaggtcgcctcggcgcccagggccagcgacagcgggttgaacggcgagtccgccgacccggccggcgtcgacttggtgatcttgccgagctcggaggtgggcgaatactggcccttggtgagcccgtagatccggttgttgaacagcaggatcttcaggttgacgttgcggcgcagcgcgtggatcaggtggttgccgccgatcgagagcgcgtcgccgtcgccggtgaccacccagacgctcaggtcggggcgggacgcggacaggccggtggcgatcgccggggcgcggccgtggatcgagtgcatcccgtaggtgttcatgtagtacgggaagcgggacgagcagccgatcccggagacgaagacgatgttctcccgggggatgccgagctcgggcatgaagccctgcacggcggccaggatcgcgtagtccccgcagcccgggcaccagcgcacctcctggtcggacttgaagtccttggcggtcagcgtcagcggttcacccattcttgaccacgtcctccagcatgctctccagcgtggcggcggtgaacggcaggccgctgacctggttgaacggaaccgcgtcgaccagatatctggcccggatcacgtgggcgagctgccccaggttcatctccgggatgaccaccttgtcgtacgatttcagcacctcgcccaggttgtcgggcagcggcgacaggtgtcgcaggtgcgcctgcgcgatcgtgaggccccgctggcgcagcgcccggcaggccgccccgatcgggccgtaggtggagccccagcccagcaccagcacccgggcggcctccgacgggtcctcgacgtccacgtccggcaccgggatcgcctcgatgcgggcggccctggttcgtaccatgaattcgtggttcgccgggtcgtatgagatgtcgccggtccggtcggccttctccaggccgccgatccggtgttcgagccccggcgtgccggggaccgcccacggccgcgcgagcgtctcggggtcgcggaggtagggcaggaacctgccgtccggcgcgttcggtgtggtggtgaactcgacggtcaggtcgggcagctcgtcgatcgagggcagcagccacggctccgaaccgttcgccacgtagttgtcggagagcaggatgaccggggtgcggtaggtcagcgcgatccgcgccgcctccaacgcggcgtggaagcagtccgacggggatttcggcgccaccaccgcgagcggcgcctcgccgtgccgaccgtacagcgccatgttcaggtcggcctgctcggtcttggtcggcatgccggtcgacggaccggcccgctgcacgtcgacgatgaccagcggcagctccagcgcgatcgccagcgagatggtctcgcccttgagcgccacgccgggcccggaggtggtggtgacccccagggcgccgccgtacgccgcgcccagcgccgccccgaccgcggcgatctcgtcctcggcctgcatcgtggtgacgccgaaccgcttgtgcttggacagctcgtgcaggatgtccgaggccggcgtgatcggataggccccgaggaacagcggcagtttcgaccggaccgccgcggccaccagtccgagcgcgagcgcctggttgccggtgatgttgcggtaggtgccgggcggcatccgcgccggtttcacctcgtagcgcaccgcgaacgcctcggtcgtctcgccgtagttccagccggcacggaacgcggtcttgttcgcctcgaccagctccggccgcttggcgaacttgcgctccaggaatcgcagggtggactcgaacggccgcgaatacatccagctgagcaggcccagcgcgaacatgttcttggcgcgttcggcgtccttcttcgggatgcccagaccggccagcgcaccgacggtcatcgaggtgagcgcgaccgggtgcaccgcgaagccggccagtgagccgtcctccagcggactggtcgcgtagcccaccttggccaggttgcgcttggtgaactcgtcggtgttgacgatgacgtcggcgccggccggcagctcggacaggttcgccttgagcgcggcggggttcatcgcgaccagcacgttcggcgcgtcaccgggagtcaggatgtcgtagtcggcgaaatgcacctggaaactcgacacgccgggcagcgtgccggccggggcgcggatctcggcggggaaattcggcagggtggagatgtcattgccgagctgcgcggtctccgaggtgaaccggtcaccggtgagctgcatgccatcgcccgagtcgccggcgaaccggatgacgacccggtccagctgttcgacccgtttcgggggagcggccacgttcaacctccaaagagcgcgggccgatcgtcacttccacagtacttcgccgccccttacgaggacggctccggaccgttgcccacagtagccatccaccgctgccgtgggccagggtcttgggtaggctgccccttcgtggacggatatctcggctcgtacgcggtcctcggcctggtgctggcggccggggtgctgctgttcgtggcggcgttcggggcgaaccggctgctgcgcccggcccgtccggccgagcccgccggcaagcggatcccgtacgagtccggcatcgacccggtcggcggcgactgggcgcaggcgcagatccgctactacgtgtacgcgtacctttacgtgcttttcgcggtggaagcggttttcctcttcccctgggcggtgatcttcgatcggccgggtttcggcggcgccgcgatcgccgagatgggcgttttcgtcgccgtgctggcgctgggcatcctctatgcgtggcgtaagaagatcctgacctggacctgacgcgacgatccggacgggtggcgggctcgccaccggaaggccggcatgtcaacatcgtgcgcatgagtcagcttctgctcttcattgtcgtagcactggtcgtcgggacgatcgtcttcggcgtgaccgttctgctgagcgggggcgactccgggctcaccgcggtggagccggacgggcagtcggtgccgctgcccggcgaccgcccgctcggtgaggacgacatcgccgcgacccggttcgacaccgcctggcgggggtaccggatggcgcaggtcgatcaggcgctgcagcgcgcggcgtacgacatcggctacaagagcgagctgatcggtgtgctggaggcggaagtgacggcgctgcgcgagggccggctggacgacgccgactcgctgcgtgccgcccgggaggccgcggtcgccccggccggcgtgccggccgagccggccgtgcccgccgagacgctggccgaggccgaggccggggacgcggacgccgagccggccacgagcgacgaggagccggcggagagccgatgagcaacgatcctgcccagcccgggtccggggaggtcaccgccacggtgatcgtgaacgccccggcgcccaaggtcttcgccgcgttcctgaactgggagcggcagtccgactggatcccgttcacccgggtccgggtggccgagggtgacggtggtgagggcagcctggtcgaggcggtcaccgcgctcggcccggcggtgctgctcgacgagatccgggtgaccaaggtcaacgcgccgtacgaggtgcgcgtggtgcactgcggcaaggtgctgcgcggcccgggcgcgatgcgctgcaccgcgatgtccggcgaccgcacccaggtggtcctgcacgagtggttccagctgccgcccggctcggtcggcaagctggcctggccggtgctctggcccggctcgaaactcggcttcaccggcgcgctgaagaagttcgcccgcctggtcgagcagggccggctgccgtgaccggtgacctggtgatcggcgacgacgccaaggcccgctgcttctggggcggcagctcaccggagtacgcggcgtaccacgacgacgagtggggcaagccggtccgcggcgacgacgccctgttcgagcggctcaccctggaggccttccagtccgggctgtcctggatcaccatcctgcgcaagcgcccggcgttccgggccgccttcgacgacttcgcgatcgccaaggtcgcggcgtaccgggaggccgacgccacccggctgatggccgacccgggcatcgtccgcaaccggatgaaggtggacgccgcgctgcacaacgcgcgggtcgccgccgagctggctcccggcgagctgaccgacctgctctggtcgttcgccccgccggcccggacccgcccgtcgaccagggcggacgtcccggcgaccacgccggagtcgacggcgatggccaaggcgctgaagaagcgcggattcaagttcgtcggacccaccacggcgtacgcgttgatgcaggccaccggcatggttgacgaccacctcaccggctgctgggtgcccgtgcttcgataggggcatggcgcagtggtcggtggtccttgatccggagcagtgggcgacggaacgcttgttccagcaggacgtcgtggtggtgcgcggcgcaccggccgggctcgcggccggcgacgaggcgctgctgctcgccgacggccacgtggtcgccgtgacccgggtggagaaagccggggagtacgccgcgctcgcctaccagcgtcgggctttcgacgagccgatcccggccgccgggctggccgccggcccgctcgccggggccgagttccaccgtttcgcggcccggttcgaccgggccccgcggaagcggagctggctggtcagcgtcgcgctgccgatcgaggcggccaccccggccgaggcggtccggcagtactggtcgcacgtgtccgacctgggcccgcgggagctgccgacctacgtctggccggccggggacgagctggccatgcaggccttcgtcctcggggccgaggcgaaccaggaccccgaggaagaaggcgaggactagacgcgggccctagcgaccctcgtacgccggcttctgcttgttgaggaacgacttgaccgcgttgcggtggtcggcggtggccccgcagatcgcctgggcctgtgcctcggcggcgagcgcgtcggacagcgtgccggcgtcgccgatggacagctcccgcttgatcgcgccgtaggcgacggtcggcccggcggccagccgcgcggccagttcctgggcggccggcagcacgtgctcgtcatcctcggtcagccgggacagcaggccgatctcgtacgcccgctgggcccgcaccggctcggccagcagcagcagctccaccgcccgggcgtgcccgacgatccgcggcagcgaccaggagatgccgctgtccccggccagggcgacgttggcgaacgccatcaggaacgacgttttcggcccgccgatccggaagtcggcgagcagggccagcgacgcgccggccccggcggccatcccgcgtaccgcggccaccaccggcttgggcatgctggccagccgctgggcgatcgggttgtagtgcacctggaccgtgttcaggtcggtgtgcccctgctccagcagggtggcgtgctcgcgcaggtcctgcccgccacagaaggcgccgccggcgccggccaggacgatcgcccggcaggaccggtcggtctccagcgcggccagggtgtcccgcagggccaccttgaggtcgacggtgaaggagttcatcgactcgggccggttcagggtgagggtgacgaccgcgtcggtgcggtcgaccaggagcacgtcagtcattggccgaatctacctttgtcgtgcaggcagcgttcgacgtaacggtcggcggccggacgcagccgggcggcgtgcttgtcgaagaagagcgcggcccgcacccccggccagccggccggcagcagcgcggcgggcagctgcgggtcctggaacagaaacgagcgccaggcgtgcaccaggcggaaccgggccgcgtacgcctcctcgtccgggctgcggccggtcaccgccttcaccaccggacgcagttcgtcctggaactcccggtaggaccggccgatccggtccaggtcccaggccctgccgacgatcccggcggtacccggcgagccggccgtgtgcgcggcgctgaaccggtcgtacgccgcgcccgcctcgtccagcaccgcgtccagctcgtcggaggcgcgcggggcgacccagacctggtcgctgagcgagccgtaccccagaaaggcgagtcgttccgcctccggccgtgccagcggcgggtcgtgcagcatgatcagatcgaaccggccgtcccagccgccgcgaccggttcggtacacccgggcggccgcctcgtcgagccgccgcgccgccttgggggtgagcagatagcccggtcccgcggtcatccgcagtgggtgcagccagccctggcgcaccattcgcgacacggcggtgcgtaccgccggtgccgcgatgcccagcggggcgagcagccgcaccagggcggccaccggggctcgcgagccccgggtgcgcaggtagtcgccgtacaggtcgaagagtgcggaccgcgcctgcatgaccgcacattgtgacagcccgaaagacgatatgctagacgctgtcacatccgcccgggctgggtttgggttcgccggtgttcatcagggaaaatgtttgatcggcacggtgggccgcaacgcgtgaagacgtgaaacggcctgtacggccgccggtcggaaacgagcaccgcgtcacgtggggctgagcacgtgacgcgctgctggcattccaggagcaagtggctgtggggtaacccaccgaccctgacgaaggtctgaggggagacaagatggcggcgatgaagccgcggacgggcgatggtccgctggaggtcaccaaggaggggcgtggcatcgtcatgcgcgtcccgctggagggtggtggccgtctcgtcgtggagatgaccccggacgaggccagcgcgctgggtgacgcgttgaagtcgatcgccggctgacgtttcacgcgagcccgccggtacggtaccgcccgtaccggcgggctttccacgtcttacggaaaggtcatcctcccgtgttcgcaatcgggttcactgaagcattcgaccaggagcgcacctgggtggtgccggccggacacgtgccgccgggcgaggtcggcgacgagatcgccgcgctcgccggggtgctgccggacgagatcgtggtgctgccccggccgctgcgtcgcccggcccgggtcctgctggccggggtcggcgacggcgacgaggcgggctggcgggccgccggcgccgggatcgtccgggcgctcggcgacgacgagccggtccagatcctgctcccggacaacctgcccgcggccgcgctccgcggcctcgccgagggcctctggctcggcggctaccgctaccgcgacggggtcaaggcgccgcggtccggcgccgtcgatctggtggtccagaagccgactgcggcgtacgccgcggctctggcccaggcgtccgccaccgccaccgcgacctggctggcccgcgacctgaccaacacgccggcctcgaccaagaacccggagtggttcgccgaccagatcgtcgcgctcgccgacggccgccccggcctgagcgtgaccgtccgggccggcgacgacctggcccggttcggcggcctgctggcggtcggcggcggttcggtctcgccgccccgtttcgtcgagctgtcctgggccccggagggcgccaccacccacgtggtcctggtcggcaagggcatcaccttcgacaccggcggcatctcgatcaagccgcgcgacggcatgaagctgatgaagaaggacatgggcggggcggccgcggtgctcgccgccacgctcggcgccgccgagctgaacctgccggtccgggtcaccgcgctggccccgctcgcggagaacgcggtcagcggatcggcgttccggcccggcgatgtgatcacccactacgacggctcgaccacggagaacaccaactccgacgccgagggccggatcgtgctggccgacgcgctcagctacgcggccgaccggctcgaccccgacctggtgctcaacctggccaccctgaccggggcgaacgcggtggccctgggcaagcgcacggccgccctctacagcccggacgacgatctggcggcggcgctcaccgcggccggggaggcggccggcgagcggatgtggcggctgccgctggccggcgagtacacggagaacctgcgcagcgacatcgccgaccggatcagcgcgccgagcgggccgggctcggtgatggccgcgctgttcctgcgcgacttcttcccccgggtgccgtgggcgcacctggacatgtccgcgccgagctgggccgaggcgcacgacggcgaactgaccaagggcgccaccgggtggggcgcccgcacgctgctgcggtacctctcagcgcttgacggcggtcagtaacccggcgccggcggagatgaccgcgggaatccactcctcggactcgcggaccaccttcaccgtctcccgcaccatcagggtgtccacgtcacgggcggccgggtcgttgatccggccgccggcgtgcaccccgttgacgatcagcaccccgcccgggcgcagcagccgtagcgccgcctcggtgcacgcggcgaactcggtggtgtccgcgtcgacgaagatcaggtcgtaggcgccgtcggcgagccggggcagcacgtccagcgaccggccgctgatgatccgggtgcgtgacggggcgaaaccggcctcggcgaacacccggcgggcgatccgctggtgctcgtgctcgacgtcgatggtggtgagcaccccgtccgggcgcatgccgcgcagcagccagatgccgctcaccccggtgccggtgccgatctcgaccaccgccttggcgttgccggccgcggccagcaggcgcagcaccgagccggcgcccggcgagacgcagggcaggcccagctcgttcgccagcgagcgggcggtctgcaggatcgggtcctcggtcgcgtaggtctcggcgaacggcacggcgtggcccgatggctggccgaaggagcgggcgggaccgatgatgacgaacctccgtgcggggcgggcgacgtgccggtgaccgatcggaaccgcgcacatcggataagagagtagagcgatggatacccgtgatgcacggcgctgtcgatggataaaccggccggtcggtgcttcccggtcagcactggacgccgcgccaccgggaatccgtgtcattctggaggccgagcctggcgagcgatgagtgggagggtccgacgtgaccgacggcgggaactggcaccggccgccccccgggcccggctcgccgtggtggagcgacgcgctgcacgatccctggcgcgacccgtatgctccggccgccgtggtgctgccggccccggcgcccaccggcggtccggccctggacccggtgcccgaccccgacgcgccccgccggtcgtacgctccggtgctgctgatctgcctgctcaccgccctgctcgcggggggtgtcggcggcaccctcgggttcgtcttcgcggtccgtggcggctatgtgggcgccggcggcacccggctcggcgcggccggccagcagtccccggtgagcgccgcgcgggacccgcagtcactcgccggcgtcgccaagaaactccagccgagcgtcgtcacggtgcacgtgacgggtgcgatcggctccgggttcgtggtgtccgcggacggttacgtgatcaccaacgaccacgtggtggacggcgccggccccaccatgtcggtctccttcagcgacggctccaccgccgcggccaagctcgtcggccgcgacccggagtcggacatcgcggtgatcaagatcgcaaaaggaaatctgcccgcggtcccgttcggcgactcggacgcgatcgcggtgggtgacccggtgctcgccttcggttcgccgctcgcgctggagaacaccgtgacctacggcatcgtcagcgcgctggaccggaccatcgaggccggcgagtccggcggcaccacccgctactacgccgccatccagaccgacgccgcggtcaaccagggcaactccggcggtccgctggtcaacgcggccggccaggtgatcggcgtgaactcggtgatccgttcggtcggcgggtcggaaaccgaggccggcaacatcggcctcgccttcgccatcccgatcaaccaggccaaacggatcgcgcaggacatcatcgacaccggcaaggcccggcgcacggtgatcggcgccgaggtgaccagcggcggcaccggcaccagcggcgccaagctgcgttcggtcgagccggccggcccagccgccgcggccggtctcaaggccggtgacgtgatcaccaagctggacgggcggccgctgcaggacggcaccgatctgatcgccctggtgcgcaagcacgccccgggcgcggtagtcgccgtggagtaccgccgcggctcgaagaccgtgtccgcctcggtcaccctgtcgtcctcgaccaactgaaggtcggggtgtccgggcaccggcttcgtgcgtacgcttgctcccggacgcctggaggccgctcgtgttcgagaatctgaactggtgggagatcggcgcgctgctcatgctcgcgctgctgatcttcggggaacgcctgcccaaggtgctgggggacgggctgaagatgctgcgcgggctgcgggccatggcgcagaacgccacctccgacctgagcaaggagctgggcaccgacatccagctggaggacctgcatccgaaggcgttcatccgcaagcacctgctcagcgaggaggacgagcaggccctgcgcaagccgctgcagagcctgttcgacgacgtcaagcaggacctgaacggcgtcaagaccgagctcaacggggtgaagacgcacctcagcgagaccgcggcggacatccggggcgcggcctcgacctcccggcagacgactgcgccggtcgaggctccccgaccggcgcagcgatacgacttggacgcgacgtagggcgtcagcccttcttggcgttcaccatcaggcccagcggcttgccgaccagggactcgcggcggacggcgagcttgtcggcgacggcgtcgagggccttggcggccggggcctccgggtcggccagcacgatcggggtgccggcgtcaccggcctcccggacccgggtgtccagcgggacctgaccgagcaacggcacccgcgcgccgaccgtctgggtcagcgactcggccacggtctggccgccaccggcgccgaagacctccatccgcgagccgtccggcagctccagccacgacatgttctccacgacgccgaccaggcgctggtgggtctgcagcgcgatcgcgccggcccgctcggccacctcggcggccgccatctgcggggtggtgaccaccaggatctccgcgttcggcaggagctgggccagcgagatggccacgtcaccggtgcctggcggcaggtcgagcagcagcacgtccaggtcgccccagtagacgtcggccaggaactgctgcagcgcgcggtgcagcatcgggccacgccagaccaccgcggcgttgccggcggtgaacatgccgatcgagatcaccttcacgccgtgcgactgcggcggcatgatcatgtcctcgacccgggtgggccggctctccacgcccagcatccgcggcaccgagtggccgtagatgtccgcgtcgacgacgccgaccgacaggccccgcttggcgagtgcggcggccaggttcaccgtgacgctcgacttgccgaccccgcccttgccgctggccacggcgtacaccctggtgcgggagccgggctgggcgaacgggatctccggctcggcggctccgccaccacgcagcgtggtctggagagccttgcgttgctcctcgttcatcacgccgaagttgatctcggcgccggtgatgccggggaccttcgtgaccgcggcggtgatgtcggcgttcagcttgtcccgcaggggacagccggcgacggtgagcagcaggtcgaccttgaccaggccgtcctgcacggtgaagccctgaaccatgccgaggtcggtgatcgggcggcggatctcggggtcgtccacggtcgccagcgcggcctggatcgcgtcctcgagggtgggagcgggagcggacatgccgccaatgctacgtcgcagcccaggtcaggtcaggggtggtcttcctcccactcgatacgcgcccgcttctcccggcgcagcgcggcgtcgtccagttcggcggccagccgggccagctcggaccggatgaagtcgcgggtggccacgtcccccagggcgatccgcagcgaggcgatctcccgggtcaggtactcggtgtcggccttctgcagctgcgcgcggcgtcgatcctcgtccatggcgatccggtcccggtccgcctgccggttctgcgcgagcaggatcagcggcgcggcgtacgacgcctgcagcgacagcaccagggtgaggaagccgaacgggtacggatcgaacttccatatcggcatcagccggttccacaggaaccaggcgccgatcaccacggtcatgtagacgatgaacttcgccgtgcccatgtaccgcgcgatgctctccgaccagcggccgaacgcctccgggtcgaacttggggagctgcacccggcccggctcgcgaggctgatccaggcggtcccggcggggctcgctcacagcggctcctcgtcctcgtgggcgtcccggtcacgccagtcccgcggcagcgaatggtccagcacgtcgtcgacggtgaccgcgccgaccagccggtgcgttccgtccaccaccggcatcgcgaccaggtcgtacgtcgccatccgccgggtgatctcggccagcccgatgtccggccgcaacggctcgatcccgctgtccaccagcccacccacgatcgacgacggcggctcccgcagcagccgctggaagtgcaccatgcccagatacttcccggtgggagtggcgctcggcgcccgcgcgacgaacacctgcgcggccaccaccggggacaggtccggctcgcggatccgggccagcgcctcggcgaccgtcgcgtccggcgtcatgatcaccggctcggaggtcatcacgctgcccgcggtgcccggccggtagctcatcagctgccggaccggggcggcctcctccggctccatcaggtcgagcagcaccgcctgctccgccttgggcaactcggccagcagatcggcggcgtcgtccggatccatccgctccagcacgtcggcggcccgttcccggtccagccgggccaggatctccacctggtcgtgctcgggcagctcctccagcacgtcggcgagcttgcggtcgctcagtgccgcggccacctcgttgcgccgcgcgtccggcagatcctgcaacgcgttcgccatgtcggccgggcgcatctggtcgagcagcgccagcaggttcgacgtgccctgggtgtcggtggggccgaccaggccgcggacccggtcgtactccacctggtagacgtgcccgcgccgggccagccgcccggtgtgctcacggaccgcgacccgggtgatcacccactcggtgttccggttcaggtccatgccgatgtccaccacggtgccctgatgctcctcggcgccctgctgctcgggggccacgaacacccgacggtccagcaggtcctccagggccagcagctcgttcggccgtttctcgaagcggcgcaggttgagcgagccggtgccgagtgcgaccgcctcggcgtccatgctggtgatccgcccgatcggcaggaagatccggcggcgcagcgccatctccgcgaccaggccgaccacctgcggcgggcggttcgtggtgcgcaaccggaccacggcgtcgcggacccggcccacccggtcgccgttggggtcgaacaccggcaggccggcaagccgggccagataaaccctcgtccccatggtcaccgccccagattaggttagggtccggacatgtccaccgtggcctacgagatcgtcgacgtgttcaccgaccggccgttctccggcaatccgctcgcggtggtgtccggcgcggaccatctcgccaccgatcagttgcagaccctggcccgcgagttcaacctatccgagaccacgttcgtgctgcccccgacgtccgccgaggcgacctaccgggtacggatcttcaccaccgacgaggaactgccgttcgccggccaccccagcgtgggcaccgcggtgacgctcatgcgccagggccacttcggaccgggacgggtggtgcaggagtgcggggcggggttgctgccgatcgaggtgaccgccgcgggcgcggccaccctgaccggggccgcaccccggctcggcgtgccggtgccggtcgaggcgctgttggagatcagcggcctgacggccgaggaccatgcctgctccggatccgccgtcgcccgcgaggcgggctgcggactcgattggaccttcttgccggtacgccgttccgccctcgcccgggtggtcatcgacgcccgggcggccgcccggcacggggtgaccgacctgggcatcttcgcctgggatccggagtccgccaccgcccacgcccggatgttcgtcgccggctcgaccgtctgggaggacgcggcgaccggatcggcggcgctcggcctcggggtgtggctggtcggtgccggctggctgccggcggacgggctgtcgacgtaccacgtcagtcagggctctgaaatgaaacgcccgtcgcggctggactgcacggtgaccgccgtgggcggcgccgcgacctcggcgacggtgaccggccacgtcgtcccggtcgccaccggccggatcgctgtcccgcccttcatcggttgatcctcagcgcttgaccacccggtgcagccggaacggtttacgggtgggcacccgggccggcgtctcccgcggcgcggccgccccggacgcgtcgggaagccccggagcggacaccagcccaccctcgaccggggtgatcaacagcagcgcgcagcccgccgcccagcgcgcggtcacctcgtcggcggtgcccgcggcgttcagccgtttgccggccagctgcggcgcgatctccgaccagcgctcgccggccggatcgagccgggtcaccgtggcctcggtggtgacgatcaggccaccgtggtcgccgcgcagccggaccgtggcccgggtcgcctcggccagcccgtcggcgtgctgctcgccggggccggtgatcaccgcgagcgacgactccaccggcatgcaccagagcgcgaaggccgggccgtcacccaccgagatccaggccacggccgctttcttgatcgcctcgtcgagcacaccgttcaccccggtcatgctagtcagaccagggccggggtgcggtccaggagcgccacgacttcgctgagcgaccgcacggtgcggccggcgaaggtcgtgtcggcgtcgaagaccaggtggtcggccaggtcgtgagcggccagccggaccggggtcatgccgaccgcggcggcgccggtcagctcctggctaccgccgtccccgacatagaggcagtcccgcggctcgacgtccagctcccggcaggcggccaggtagatccgcggatccggcttgcagacaccctgctcgacggagaagatctgggcgtccagcaacggcgccaccggcagcccgggcaggaaggcgggaagctcgtgggtgcagtcgctgatcagcgccgtgcgcacgccgcggcggcggatctcggtgagcgcgctgaccgcgtccggccgcaaccgggtgtcggcgcgcagcgcgtccacccgggctggcatcgccgcccggatcgcggccggaccgggccggccgccggcctgctcgatcacccagcgcagggtggcctccgcggacccgtaccggccacaggcccgggcccggaacgtccggttcagcacacccagcaccgcctcgggatcggcgccgagcgcccgggcgatgtcggcgtgctgtggaccacgctgaaccgagcgggtcaaggtgccgaagaagtcaaacaccaccgcacggtaagcgggcatcgaaatcggcctcccaggcatcgaggggtggaaatgggcgcagagccgtcggtgactgtagcgattccgtcactgtccgccaaccgacagtggcaaacgtccctgctcgggcatgcaagaagcgacggccggtgatgaatatgcgctcatcagggcatccgatctccgcgcttacgggattggcgctggccgtagcggtgtgcgcggtctcctcgtcggccccgctgatcgccttcgcggcggcgtccgcgcccgcgctggcggtcgccttctggcgcaacgggctcgcctcggtcgcgctgagcccgatcgcgctcggcccgcgccgcgccgaagtgcacgacgcggtccgcggccgccgccgccgggccggcctgttctgtgtgctcgccggggtggcgctggccgcgcacttcggcacctggatgccgagcgtgcaactcggcacggtggccacctcgaccgcactggtcgccacccagccggtctggcagggcctcatcgccgcctggcagggccaccgaccgacggccgccggatgggccggtatcgccctggcggtggccggcgcggcctgggccaccggggccgacgtcggcgtctccggccgggccgtcctcgccgacggcctggcggtcctcggcgcgatcttcgcggccgtgtacaccgccctcggcgaacaggcccgcgcggcgctgagcaccacgacgtacacctggatctgttacggcgtctgcgccctgatcctgctggtcgtctgcctggccggcggggtgccactgaccggttacaccccacgggcgtgggcggcgatcctggccctggtcgccggggcgcagctactcgggcattcgatgttcaactatgcgctgcagcacacgtcggcgacgacggtgagcgtgctggtcctgctcgaagtgcccggtgcggccctgctcgcctggctctggctcgggcaggtgccacgcagcggggcgctgcccggcctcggcctgctggtggccggcgtcgcggtcgtcatcctgggcgccgcccgggcttcgcgccgcggtcccgtcaccccggccctcgccgacgaaccaccctcacctgaccgcccgcgccaccccaccaccgggccgggccgatcggtgaccgcaccaccgcgccgccgcgccgccgcgccaccgcaccgccgcgccgccgcaccgcgccacggcgaccccatcaccacgtcacgccgccgcaccaccgcgtcaccgcaccatcgcaccgccgcaccgcgccacggcgaccccatcaccacgtcacgccaccggtccacctcgccatccggtttcccctggagcggggctcgtcgagccctgggctcctgggcgacccgtgggcccggcaggcggctgagcgggcggggcctacggcgtactccgtccagttgtgttttgcccgaagcggccgaggagtggcgggtggaccgggagcgtcatctacaacggccgaatttccagaaatgtcgtcgtatgtaggctttcggccgtcaccggggctatcgggtggttcgttgcgttgaggagccgtcttgtgcgtcgccggggtggcgcggcggcagtgggcacggtaatgagaagggatgcgatgcatcgggtgcggctcggccggctactcctcgccggggtgctcatgatcggcggctgcggtgagtatgagaccgctgaccagccggaacagatcggggcaaccggcgagtggcggacgccgggatgcgagttcagccgggaaccggagttctccgaacgcggcgggctgcggatgccgctgaccccggcgccgctgcgtgacgcgatggaacgcatcgagcaggccggccggcaccgcttcccggacagcttcgccggcctggaggtcgaccagtaccgggtgcgcgcgatcgtctaccgggtgccgcggctctccaccgaattcgacgacttcatccgccagaccgcggcgaacacctgcatcgtggtccgggacgccgcgcacgccgtcgccgagttgaccacctggcacgaccgggtcgccgccgacctcgccttctggcaggtgcgcggggtgcggatcgtgacgatcggcagccggcacgacggcgccggcgtggaggtcggcgtccgggaggtggcgaaagcgcgggccgacatgccggcctactacggcgccgacgctccgttgatcttcgtggagcaggggccggcgacaccgttcaccgacgggtgggtggttctgccggaacacgacgactgagtccccggcgtgtcggaaaatcggttacgggagtccgggcacgcaggtcgcgcctggacgaccgggacgccacggggacccggatgtttgccccgggttcccggagcaggcaggatcgccgcatggtcttcgacgcccgctccaccggcggaacccctacgcggcgtgacgccacccgaccggccgacggccggccaccccggtccggtgtgcccggcacagacccggaccggccggtcgagatcacgcccgaggtggtcgaggcggagttcgaggaagcgagcgcggaggctgcggtgacactgcgtctggacgggaaggtcgcgctggtcaccggcgcgggcagccccgacggtatcggctacgcgaccgcccgccggctgcgtgacctcggcgcccgggtggcgatcgtgtccaccacgcggcgcatccacgaacgggccaccgaactcggcatcaccggattcgtcgccgacctcaccgacgaatccgaggtcggcgccctcgccgacgccatcaccgaccaactcggcgacgtcgaggtgctggtcaacaacgccggcctcgcgtcccgggccagccccgaggtcctccgcccggtcgcccagctcaccctcgacgagtggaaggcggaaatcgaccgcaacctgagtacggcgttcctctgcagccgtgccttcgtcagcggcatggccgaacggggctggggccgcatcgtcaacctggccgccaccgccggcccggtcaacgccctgcccaccgaggccgcgtacgccgccgcgaaagccggggtggtcggcctgacccgtgccctggccatggagctggtcgccgacggcgtcaacgtgaactgcgtggccccgggcacgatctacaccgcggcatcgacggtcaccgagatcaagcagggtctgggcaccccgatcggccgccccggaacaccggacgaggtggcggcggcggtggctttcctctgctccccggcggcttcgtacatcaccggccagatgctggtggtcgacggcggaaacagcgtccgcgaggcccagttccgctgaccatcccggcccgcgtggccgtgccggctccggctcgcacggccccgcggcccggtggcttccagcggtctgtcgactcgacagcggtccgcacgctcccacggcgtgcgagtgttgccagcggtctgcccgccaagagcgtggtccacccgctccctgaagcccatcgtcgccgtttgtgctcgggccgggaccgcctcagttgatgctcgggccgggaccgcctcagttgatgctcgggccggggccgccgcagttgatgctcaaagccggggccgccgcagttgatgctcaaagccggggccgccgcagttcatgctcgggccgagattgtcatagatgcccgcgccgggacgttcgccgttgatgcccgggccgggataagcaggcgatcccggcgtgaccaggtactggttcgggtcgacccggcggctgtcaggtgagcttgctgaggttgccgacggcgcgttcgacggcgaggcagcggtcttcgacgtagtcgatgccggcgtccgtggcgatctgccgcgcttccgccgagacgatgccactctgcagccagacagccggcgccccgatggccaccgcttggcgcaccacgtcgacggcatctcgcgccggccggaagatgtcgaccaggtcgaccggttcctccaggtcggccagcgtcggcacggtcctgatcccgaacacctcgtcgacgaacgggttcaccgggatgatccgccagccgtaccgcagcatctgcaacggcaccgtgtgcgccggcttgaaggaatcacgcgaggcgccgaccaccgcgatcacgttcgcgtccgccaggatctgctgagcactacgcatgccccgactttagccacgcccactccttcacccggtatggcttacggcacccgctcatgaccgaccccgtcccggtggcgcgttgccctgtgtctgtcagcgcgggcgcccgccggcccggtggcgcgcggcgctgccttgtgcccgcgagcgcgatagcccgccggccaagacacgccggcccaagacggggcggagctgaatggcgtggtgctacgcgtcgcgatggcccaggcgcggcagggctgtcggcacgtgttgcccgagcgcctcacagcccgcgatggcccggcgccctgacgccgccatgacccaggcaaggtgggctggcggcgcgcatacaactggcgcctggcggcccggcggcctcccgcagcccgcaactcggcggcctctcagggcccccggccccggcccccggcccgtcggcctcccgcagctcgcaactcggcggcctctcagggcccgggggtctccccgggcccggagaccggggtggctcagaggagcgtgagctggtcggatttcggcgtggaaggcacctcctccgaggtgggcagcgtgcggaactgacccggagtcgggcggtgcagaccgtggcggcgggcggccatgcggactcgagcggtcagctcgtcctggtaggagcgcggggagtaggcgccgttggcgaacagcgagcggtggcgggggatcaggtgggggtgttcgcgggcgatccaggaggcgtaccactcgcgggcgccgggacggaggtgcagtgggatcggggtgaccgaggtggcgccggcggcggcgatggcggcgacggtcgcgtcgatggactcctcggtgtcggtgaggccggggaggatcggggccagcaggacgccgaccgggaagccggcgtcggtcaggcggcggaccgcgtcgaggcggcgctgcgggctgggggtgccgggctcggcggagcgccagatccgctcgtcgacgaagccgaccgagaaggccagaccgacctgggtcacctcggcggcctggcggagcagatcgaggtcgcgcaggatcagcgtgcccttggtcaggatggagaacgggttggcgtggtcgcgcagcgcggccaggatctgcggcatcaaccggtagcggccctcggcgcgctggtagacgtcgacgttcgtgcccatcgcgatcggggcgccggaccagcctggctcggcgagctcgcggcggatcagctcgccggcgttcaccttcaccacgacgcgggtgtcgaagtcgtggcccgggtccatgtcgagataccggtgggtgccgcgggcgaagcagttgtggctgaccacgccgtcggcgatgaagtcgccggtgccggtggagatgtcgagcagcggcagggtgaggccgaggtcctcgatgtcggcgacggcgagccggcggtcggcgcggaccccgaccccggaggcgtccagcggggcgtcgagggcgccggtgaggtgccggaagcgcagcgccgcccacaggtcgcggccggtctcgacgcgtccggggcggtcggcgcggcagcggaccggggtgcggctggtcaggcccaggtgggtcagtgcctcggtgacccagcgcaggtagatgcggtcggtgctctcgaagctgagggccagccgctcggcccggccgaccgcaccgaaggcgccgcccaggaagccccgataccactcgccggacggcagctcgggccaccgcagcgcgtcggggagggagacgtcgtcgagatagccgtcggcgcggatccaggcgtcaccctcgcgggcggcccggctggcggcgtcgccgcggagcaggccgcagagatagccggcctgatagtcgggggactccttgggcggctcggcgaagtggccgaccccgcacatcaggtcaccgatcgcgagcgccggctggtgcggctcggcggggctgacgtggcgccagccgcggtcggtgaggaagcggtgatcgccgctggagaccagccgggtgccgtcggtcagggtgacgcggaacgcgggcttgctggtggcccagtggtcgagcacggtggtcggcacgtaacgccggtgcgggccggcgcccatcgtgcccatcaccgggtcgccggggcggatctcggcgagacggcgggtggacccgtcggccagcaggatcggggtgtcgccggccaggcagtaggtgcacgcgtgggagcagccccgatacgggttgacggtccactggaacggcacctgcgaggccccgggcacccggttgatcagcgacttggcgcggatctcgtagaacgtcatgccggcgaacccgggagtgtcgaaggtgcgcacggtcgcaccgggcagcgccagcggcaggggtgaagccgcgggcgctgccctgtccgggagcgagtcgtcgccggcgccggccgacaggtgggaccatcgcatggcggttattcgaacacacgtacgagatcatgtccaccgcttccggcgactgtggacacgtacggcgtacccggaccggaaaagcgaaaggcccgcggaccggttacggtccgcgggccttgaaactcgctgatcagctcgccgcgcgggcgggctccccggtgctctgcgccttcggctcgtgggccttcttgtgggccgcgacctgctcgcgcacctcgtccatgtcgagctgctcgaccttctcgatcaggctctccagggccgactcggggagcgcgccgggctgggcgaacaccacgatgccgtcgcggaccgccatgatcgtcgggatcgaccggatgtcgaacttggcggcgagctcctgctcggcctcggtgtcgaccttgccgaaggtgatctccgggtgcttctccgaggaccgctcgtaggtcggcgcgaagcgcacgcagggcccgcaccagctggcccagaagtcgaccaggacgatgccgtccgagctggtgacctcgtcgaagttcgctgtggtcagcgcaaccgtcgccattgatgcctccgtctgcgggaatcgctttcgtcgggtggaactcctggcaccctttcaccattcccgctgggcgcgccgtgacacgtgtcctacggcaccttcgccagcgggatggcccggcgacctcggagcagttaacgtaactgatagtaggcgcacggtgtcagtttgccgacaccatcggggcgggaaatctgcccatgatcacgccttgtggtccctttgccctgcctgagcattcgttatgggaacgcgaccaaccggcaaaaggaactgtaaataaagttaaatgtgagctgcgtcacatccgaaagtccttcacatggatacggacggtaaggcaaactctttcccaacagagcgtgggcggcgggtgccggggagggccccgccgctcattgcgtcttctgaaagtttcccggtgtccagtcccgggacatccccggaccaccggatgagtagcctaacgccccatgactgcgggcgaggaccaatccaccgaggtcggcgtcggcccctggcccggtgatcggcccgacggcgcgcactacgaccccgaactgctggagcacggcgaccggcgcaacgtggtggatcgctaccggtactggacccgcgaggcggtgatcgccgatctggacacccgccgccacgacttccacatcgcgatcgagaactggcagcacgacctgaacatcggcaccgtggtccgcaatgccaacgccttcctcgccgccgaggtgcacatcgtcggcctgcgcaagtggaaccggcgtggcgccatggtcactgaccgttaccagcatgtccggcaccatccgacgatcgaggatttcgtgggctgggcgaccgccgccggtctgccggtgatcggcatcgacaacctgcccggatcgcgcccgatggagaccgtcaccctgccgcgccgctgcgtgctgctgttcgggcaggaggggccgggtctctccgacgtcgcgcgtcacgcctgtacgcagttgttctcgatcgcgcagtacggctccaccaggtcgatcaacgcgggtgtggccagtgggatcgcgatgcacgcgtggatccgggcgcacgccggcccaccgcccgcctgagtccgccgtgttctgccgatccgcttgacggcggctctccggacccgcacggtagggagtgtgggtgtcacggtgagttgccccagatgtgctgatcaggtccggaagccggatctgatgcacagtaactggcgttgcgacaactgtggcgacgttccgccgttccatgtcgccgagcacatcagtgcggagatcgtcggaacggtgctgcgggagtcggcgtcgggcgccgagcggatgccgctctggggcccctggccactgcccgccgggtggacggtcaccggggtgggctgggccggcgacgaccgttccggggtgcgcgccaccgcgctcgcctgcagtgggccggagccgctcggcggcgggccggccgatctggtcttcatcgccgagcagccgggggtgggcctgggcacccggttcgccggcatccccggcatcgatcccggttacctgctctccgagacgctctccgactgcggggtcaacggcggtccacacgcgaagatcaaggtcggcgggcacccgactccactatggtgtgtcaagtcaccggaggatcgaagcgcgtacgtgagtgaggccaagggaatctggctctatgcggtagcgtggcccgcaagcgcgggctatctcctcgcggagcacgtcgtcctgcacgatctctccgacggggtgccagccgagctggtgttcggagcgccctcgccgtacctgcacggtcgtgtctgaccggctatcggctttctgggcactttgttcacacgaagcaacggagctgataccgtcagtactgccgcggcgttgttggtcacccgcaccagaggagaaggatcgccatgatcaagaaggtgctcacctggcttggtattgcgttcttgatcttcttcatcgcattcaacccgagatcggcggccgcggtcttcgagtcactcgggggcacgatcgcggacatcgcacgaggcttcggcacgttcttcaccgacctcgtcgcatagcatctctctatggatcctggtgagccgcgcgacccacggggcgagggcgcccagcgccctccggacgacgacgacgccttcaggtatcgggaccccgccttcgaggacaccgatcccggtcagacgcgtgccgagacctatccggacgacgagcgcttcgctcatcaggcgcggcgtgccgacgagtacgacgatcccgatcagtacgaggcgccggtcttcaccgaggaggagctggaaggcctcgaccgtggcggcggcccgcggcgcttcctccccctggaggacgaaccgaccacactggtcgcccgctatctgttcccgaccgagcgttaccgcggtgagtggaagcggcactggatccacctgtccctgccgctgagcgtcggtgccggtgccaccctgctgctgggttatctggccggcttcctgacccggcagaacgtggacggcatggtcaccgtcgcggtgctgatctggctcggcgtgatcagctgggtggcgtggaaggtcttcgactggtatttcgaccgcttcatcctgaccaacaaacgggtgatggtggtcaacggcatcgtcacccgcaaggtggcgatgatgccgctgctgcgggtcaccgacatgaaatatgaacaatctgccctcggccggatgctgagctacggcacgttcgtgctcgagtcggccggtcaggatcaggcgctgcgcgaggtcaagcacctgcccaaccccaacgagctgtacctgcgggtggtcgaggagatgtacgagccgcaggcggtcgaggcgcggctgggcaaggacgatgagggagacgacgcctgagcatccggatcgatctgcactgccactccaccgccagcgacggcaccctgaccccggccgagctggtccgggcgggtgccgaggccggtctggacgtgatggcgatcaccgaccacgacaccaccgggggctgggccgaggcggccgcagcccggccggacgggttgcggctggtccgtggcgccgagctgtcctgccgctggcacggggtgcagccggggatctcactgcatctgctggcctatctgttcgatccggacgatccggcgctgaccgccggcatgctccggatgcgcgccgaccgggagcagcgggccgagcagatcgtggacctgctgcgcgccgacggggtgccgatcacctgggccgaggtgcacgggtacgcggcgggtggctcggtgggtcgtccgcacatcgcgcaggcactgatcagagccggtctggtggacacgacgacggaggcgttcgcgtcggcctggctgggcgcgcggtacttcgtacccaaattggatcttgatgtttttgaggctgttgaagcggtgcgagcagccggtggggtagcggtcttcgcgcatccgcgggcgaccaagcggggccgggtggtgccggacgagttgatcgtcgcgctggccgacgcgggccttttcggacttgaggccgaccatgaggatcactcgcccgaggagcgcgagcagatcagggcgctggcggatcggctcgggctggtcgtcaccggaagttccgattttcacggtacgcacaagacggtgcgcctgggagccttccagaccgcggtggaggtgtacgacaagatcgccgccgccgccaccggagttcccgttctcgggtgacgatcgccgcaccagcctgcgcgaaacagtgccgcaacctaccttgatcgggtgaatgtcaagctgttcggcgagttctacgtgaccctgctggtgatcgtcgatccgcccggcatggtcccggtcttcctggcgctgaccggcgccctgcccgcgaaggcccgcaaccgggccggcacccatgcggtgctgctcgcgctcggtgtgatcgtcgggttcgcagttgccgggcagaccctgctggactacctgcacgtgcggctgccagccctgcaggcggccggtggcctgctgctcgtgctggtcgcgttgcagctgctcaccggcaagaccgacgagcctgaggagcaggccggcaccagcaacgtggcgctggtcccgctcggtacgccgctactggccgggccgggcgcgatcgtggccaccatgctgttcgtgcagcggtacaagagcctcgacggatacctgatcctgggcgccgcgatcctggccgtgatggccaccgtgtggctggtgctgcgcttctccgggctgatcgtgcggctgctgcgcccggccgggatcgaggtgctcacccggatcgccggtctgctgctcgcggcgatcgcggtgcagctcatcgcggacgcgatcttcgccttcgtgcagttgtacgcgccgcgcctctgacgattcctgtcggagggtgctggcaggattgtcccgtgccccccaccaggaatcgcgccgccgtccccgagcagctcggcttcgccggcatgcccgagcgcctgttcgtctgcaccccgagcaagctcggggcatacctcgactgcccacgacgatatcgatattcgtacgtcgatcgcccctcgccgcccaagggaccgccctgggcgcacaactcgctgggcgccagcgtgcacaccgcgctgaagaactggtatgccctgcccgccgagcgccgcgagccggacgtcctgcccaccctgctgaaaagcacctgggtccgggagggctaccgggacaccgagctggagcgcgccgcgtaccgcaaggcgctgacctggctggagagctacgtcgccaccctggacccggaggacgagccgctcggcgtcgagcgggtggtcgccgccaaaaccgcggtgctcgcgctgaacgggcgggccgaccggatcgacgcccgggccggtgagcaggggccggaggcggtgatcgtcgactacaagaccgggcgcaccgggctggacgccgacgacgcgcgcggatcccaggccctggcgctgtacgcgtatgcggcgcaacgggtcttccgccgcccctgctaccgggtggagctgcaccacctgccgaccgggacgatcgccgcgcacgagcacaccgacgagtcgctggcccggcaggtccggcgggccgaggagaccgcgcaggacatcatgaccgcggagaaggcggtggccgccggggccgatccggacgaggtgttcccgaccaaccccgggtcactctgcgggtggtgcgacttccgcaaggtgtgcccggccggggcgcaggtggcggccaaggagccgtgggccgccgtcgagcacctgggcgccgcctagccgacgcgttgcagggcggcccgctgggcgggggagatccggtattcgtccgggagcaccgccagcactccggcgagcagggtgcgcaggccgcgggcggacaggccggcggccaggtcggtgaccggccagccgggcgcgccgtacaacctgcgcgcccagggtgggagcaggccgatcgccgtgctcgccaggctcagataggcccagcgggtcgggccgagggtgaggccgagccgcaccgcccggttgccccagctgtccgggatcggcgggacggtcagaagcatcgcggcctccgcgccatccctggtcaggcccagttccgggcggatcgccgcatagaagtcggcgacctcggcggcggtgcccggcacggtcgccgggtccaggccgaccagcgcggcggcccgcaactgctcggtgtagtacgcgtcgatctcgtccggggtgagccgcaccccggcccgcagcgcggtggtcaggaacgactcgacctcggccacgtgcacccagcgcaacagatccggatcatcgatccggaacgactcgccggtacgcgggtcgaccccgcgcatcccggcatgcaaccgtcgcagccgggcgctcgcctcggtcacctcggccgtgctgccgtagatcaccgtggcgacgtaaccggacgtgcggatcaggcggccccacatgtccgtgcggtagccggagttctgggcgacgccggccaccgcgcgcgggtgcagcgcctgcatgtagagcgagcgcagcccgcccagcatcaggatcggctcccgatgcagtttccaggtgaccgaatcaggtccgaaaagtcccatatcgccgggtgtccggtcatcacggtcaccgggtacccgggcatcacgcgatcggctcatccaggcatcatgcggtctcggcgagccggcgcgcctggcagtccgggcacaaaccccagaacgtcacctcggcctcgtcgaggctgaagccgtggttgtcgctcggcgtcaggcatggacgctcgccgaccgcgcagtcgacgtcggcgatcgcgccgcaaccgcggcagacgatgtggtgatggttgtcgccggcccgcgcctcgtagcgggccgggctgccggccggctcgatccgccgggccaggccggcccgggacagagcgcccagcacgtcgtagaccgcctgggtggagaccgagtcgagccgggtgcgcacctgcctggcgatgtcgtccacctcgaggtggccgccgccggtcaacacctcgagcacggccagccgagggcgggtgacccgcaggccatgcgtgcgcagcagctcttcaccggtggacattggtccatgacaacacggccgcgcggtttccccaacctgagagaagtcacagatgtcctggtaactgactgaaccgaacacggatttccgcggtaaatgctgctggggggatgtttgcgtcgtcagacatccctaagctagcgatcaccccggacccaggaggaaaagtgttcgaccaggtcaacggcttacccgtccatgctctcgtgctgcacgccgccgtggtgttcgtgccgctgctcgccctcggcgcggtcgtctacgcgctcgccgcggcgtggcggccacggctcgggtgggcggtcgcgatcctcgcggtggtcgcgccgctctccacgttcgtcgccaaggaatccggtgagaagctgtacgaccggctggcgtcgcacggtctcaagggcaagggcctggagatcctcaacgatcatatggactacgggtcgatgacgctctggttcgccctgggtctcggcgtggtgagcctggtgctggtgggtctgacctaccggggtgggcgccggctgccgctggtggcgaacgcggcgttcgccgtggtgatcctcgcgctggcggtgggcagcgggtactacatcttcaagaccggtgactcgggggccaccgcggtgtggggcagttactgatccggggcgttccgctgccgggcggtggcgttccggcagcgggttctcacagcagggcgcggccgcagagcaggcacatcaggatcagggcgatggcgccggcgaccaggccgaccccgtacgtcacggtccgcgcggcaccctccgcctcgtcgatggcgtccatgtcctgagccggcatggcgcgtggcgggggcggcgtggcgatggtcggcggccgccagtgcgggggcggcgggtcggcgcgcggcgggcccggatagtccggttccgcgggcgtggccggccgttgctgaggcggcccgctgagcgagggggcgcccggatcgggccgctgccagaacgcgtcgtcgtcgggggaactcacgttcaccgacggtacagccggagggggacgacggccgaagcgatgtcggcttacccttctagacgtggacatcctggacggccccgagcgggacggtgacgccgagcgggtggtggacttcgagtcggaggaggctccgctgctgcccgaccagactcgggacgacaccgagcgtggctggggcgagcgtgactactccaacgacgatcgcctgctcgacgatcgtccgccgcactgggattgattttcgaccccgtggcggtacgtcgacgggtcctgacgccctcctccccggcgaccgccggggaggtgcggatccggctgtccggattcctccgcggtggcgctgagccggtccttcgacggtggcgctgagccggtccttcgactagctagctagcggcggcggtcagccgggccggatcaggatggcgaagccgctgcccggtggagtgagcgcccgctgcgcctgagccgggccgagcgccagcaggagaccgccgcttgccgggtcatcggcgccggtcacgtcgaggaccaaggcggcgctggcgatcggggtgccgtccgcccggtcacccaggcggatgaggtcgacccggttgccggggtgaaccagggccagggcggtcgggtcggccagtcgcaccggtacgccgacggtgccgtccgggatcggtggcctgccttgcggggccggggaggcggaggggcggaccggagctcgggggctgctcgatcgtttcgccggtgccgggcccgcggtcgtgcaggacgtccccggggaacgcgaccagaccaggaccgctgccgctgccgtggcgagcaatgcggtgatcacggtgagtcgcagcagggagccacggcccggcgcacgccagcgcaccggatccagacgttcccgggatctgcccatcgtcgtgccctccgtcaccggtcgcgggtgttccggcgggcgacgctaggcgatttccggcccggctgccgccaggcctgtggacaaccccgcactgtggacgaccggagaaatgtcggtgggccggtttagtgtggggccgcggcaggaggaggcgggcctgacgcggtgtcgcttgacaactggagagcgttcggaaggccgcgcggatgaccggcggcggcgcacatggcgaagggcgcgccgggtggcacgcccttcggatggttcggtggatcaggaggcggcggcggccttcgcgccggacgaggagctggtggtcgacgaggatgtcgacggggcgctgctcgtggtcgtggtggccggcgcggcggcggtcgaggtgctctccgacttggtggaggtgtccttcgcggtgtcgccggagccgcccgacttctcggcgctgacgctgcccgaccgggagtcgttgcggtagaagccggagcccttgaagacgatgccgaccgagttgaacaccttacggagcttgccgtggcagttcgggcattcggtcagcgccgggtcggagaacgactgaacggcttcgagctgctcaccgcactcggtgcaggcgtactggtaggtaggcacggctcctccggatctgtcggctgctggcactcgccaactccgagtgccaatgttgcggcatcggaggtcaattcgtccactccgggccgggtctgaggcccggcgcgccgccggatgtgacgaagtaggcgacccgacggctcggacgccccgctcagcggcgggcgccagcggcccggacctctcaggccgggcaggcgatgaagccggcggacggggtgagcacgccgtggaccgggcggtcgtggggctcggacgggacccggtcgaggatttcgccgtcgtggagcagagccaccaccagcgggcccggggagggcaggcgggacagcgcgcggtcgtaggagccacccccgcgacccatgcgaatgccgtcgcggcccacggcgagggccggaacgaggatgaggtcggccgaggtgagcgcggtgacgcccaggcgtgggccggtgggctcgtgcaggccgcgcgaggcgggggttagggagccggtgtactccgcccagtcgagatcgttgtcgggcagcaggacgggcaggagcaggcggccgccgggcgggagggcggcccgcagcaggtcgggcagggtggggccgccgggctccgggcccgacgggacatacgcggcgatggttcggggggtggcgcgccgtaccagggcaagaatgtgatcgtgaagttgggtggcggcgacggctcggtcggcggccgatcgtgatcgacgtgcggtgagtagttgtgtgcgcagagtgatcttgtcaaagggtgatttttccgcaggaccggctaaatccgacatgcaacacccccttttggaaaccggcaaacggcgcacactatgtcagcatcgctccaaagagggccactcccgggaggatgtgtgacattacgtggccggctcaccagcgccttcctggtggtcgtgctcggtccggtcctgctcgggtccatcttcgtcgcgctcaccgtctccgcggtcggccgggagcggacgaacgagcgcctcgaccatgccgtgacgaccgtccgggccgctgtcggggcgatctgcgggcagcttcaggcggccgccgacgcggtggcggtggtgccggcggagtcccggtccacggtcgccgaccagctgatcgatcgcggtctggccggggacatccgcgtcgatgacacgcgcccggcggcctcggggacgggtgacccgacgggcgtcgaggggccgggcggtccgagcgcgacggcccggggtgcgggtggcccgatcgggttggcccggcgctccggggtggcggcggcaccggaagccgcggcgccgccggtggtgatcgctcaggacggcgccgggctcgcgaatccggtcgggtggcaggactgcgccgcgccgcgcggcgggacgatcaccgcgctggccgcatcggcccgggccggggagatcaccgtggtcgccgcccagcgggtcgacgccgagctgctgcgccggttgggggagagcgcgggagtcaccgtcgctctcaagcttccggagaccgattcccggcagagtgacggcgagctcccggcgagtggtgatccgcaggctggaccgaccaacgggagtggtgatccgcaggcggggctgccggccgggggcagcccgggtgccgcagcgggaaggacgggcgactccgggcagcccggagccgggacgaccgggacggtgggggaggccgcgagccggcgggtggagccggcggcgggtcagccgctgccccttctgctcagtgccccggtggggcgcagtggcttccggtatgccgttctgccgctgatcgtgttggtcacggcggtgctggcggtgatcgccgcgcggtggctggcgcggtcgacgacgcggccgctcggcgagctcgcgtgggccgcggatcgggtggccaacggggacctggacacccgggtgccgatcccgcggccggatgagttggggcggctggcggggacgttcaaccggatgacccgggagctgcagtcctacgtgcaggcgctgaccgcgagccgggaccagctgcggcggcacctggcgatcctcggggacaccctgtccagcacccatgatctggaccggatcctgccggtgatcctgcgtacggcgatgaccaccaccggagcccgggccggactggtgctgctggtggatccggcggacgggtcgctgacggcccgctgcggcgccgggctgaccggggactgggatctgccgccggcggaactggtgaagcggcggctggccccggcacggggggtgctgggcgtggtggccgcctccggcgtcgccctgcgaggggcctccgggggcccgagccgggccgcggacgccgcggacgcaccgtcgggtggcgcgtctcacgtggccgggggagtcgttccggacgggccggtggcggtggtcgccgaggagccggtgtgcgagtcgtacctcgcggtgcccatctgtgcgccaccggtgggtgacatgttgctggacgaggcggaggccgggccggggacgctgggcgtgctggccctctatgaccggctggggagttcctccttcgacgatgcggacctgcggactctccggaccttcgccgggcaggccggggtggcggtgcgcaacgtgcgggtgcacgaggaggcgcagcggctgtcgctgaccgatccgctgaccgggctgtggaactaccgctacctgcgcgaggtgctgcggcgtgaggtggagcgggccagccggttcgggcggatgctcaccgtgctggcgctcgacctcgaccacttcaaggaggtgaacgacacgtacgggcatccggcgggtgatcaggtgctgggtgagttcgcgcggcggatccggatggggttgcgcgaggtggacgtggcgttccggcagggcggggaggagttcgtggtgctgctgccggagaccgacgcgtacggcggagtgatcgtggcggagcggctcggcgccctggtccgggaccggccggtcgtggtcgacccacggcgtccggggcaggccgaccggatcccgatcagcgtgtccatcggcatcgcggtcttcccggagcatgcggacaccgcccagggcgtgctcgatgcggcggacgaggcgctgtacgcggcgaagaacgcggggcgcgacacgtatcgtctcgcggagagcgtttcgtcccgaacggtcgaggggaatttcgctcccgcccccgccgggagcgggccgcaaccgccgcggcacggttccggccgatagtctcgctgcatgcttgcgagcgaacgtgcggtgcgggcgtgtgaaagtgcatagcgagcgaacccagccgggcaagatccagcgaaggtgcggtgactgatgacgacgaacgcgcaagggtcgggcaagcgcgcggtgaaagcagtgattccggcggccggcctagccacgcgtttcctgcctgccaccaaagccgttccgaaagagctgctgccggtcgtcgaccggccggtcctgcagtacatcgtcgaggaggccgccgcggccggcatcaccgacgtgctgctggtgaccgggcgtggcaagacctcgatggtcgaccacttcgaccgtcgccccgacgtggagcagcggctggaggagaagggcgacaccgagcggctcgccgccgtccggcgcaccagtgagctggccgacatctacacctgccgacagggggagccgctcggcctcggccatgccgtcgggaccgccgcctcgcacgtcggggacaacccgttcgcggtgctgctcggggacgagttcgtcgaggagggcagcccgctgctgcccgacatgctcgacctgcaggcccgcaccggcggcatcgtgctcgccttcatcgaggtcaccccggaggagacgtcgcgctacgggatcgcctcggtgcgggagtccgacctgggcgagggcgtggtcgaggtgaccggcctggtggagaagccgtcgccggaggaggcgccgagcaaccttgccgtggtggggcggtacgtgctgcctggcaggatcttcgagacgatcgccggcaccaagccgggcagcgggggcgagatccagctgaccgacgcgatggcgacgctgctggccgagggcaccccggtgcacggcatcgtctaccgcggtgtccggtacgacaccggccagccgctgggctacctgcagaccgtcgtccagctcgcggctcagcgtcccgacctgggtgccgagttccgggcctggctcaccgacttcgtcggtggtcagaagggatgaccgctacggccgatgccgaggcggccgccaacgagctgatgcctctcgccgagtacctgggcagcgtgctgcgcaggttgcggacgctgcctccgctcgacctcgacctcacccaggcgcacgggaacgtgctcgcggccgacgtgatcgcgccgcacccgttcccggcgttcgaccaggccgcgatcgacggatacgcggcccgctgggaggacctggccggcgccgggcgcctcggcgcgcacccggcgttcgggcagcccgagcacccggcccgcggcgtccggctgaacgtggtcggcgacctgggagcggccagctggcgtccggtccggctgaccgcgggcacctgcttctcggtggcggccggggcgccgctgccgatcggggccgacgtggtcgttccggtgcactggaccgaccagggcatggccgcggtggagatcctgcacgccccgaaacgcggctccggggtgcgccgggccggtgaggaactggccgtcggtcaggtgctggccgccgccggggcgtacgtcacccccccgatggtggccaccttcgccgccgccggcatcgggcacgtgctggtccggcccagcccgcgggtggtggtcgtggccaccggcgacgagttggtcgacgtgggccggcccagccagccggggcaggtggtcgacgcgaactcgcacgcgctgaccgcggccgcggtggaggcgggcgcgctggcctaccggatcggcatctgcgacgacgacccggaggggctgcgcgggctgctcgaggaccagaccctgcgggccgacctgatcatcacgaccgggggcaccggtaccgggcccggcgacatgctgcgccgggtgctgtcccggcccggcaccggccgtggcgtggtcgagttcaccgacgtcgcgctctgcccggggaccgcgctcggcttcggcacggtcggcggcgaggaggtcccggtggtgtgcctgccgggcgagccgggcgccgcgctgatcgggttcgaggtgcttgcccggccggcgattcagctgctcgccggtgccgagccggtgttccggccgagcgtcaaggcgcacctgctggagaccgtctcgtcacccggtgggctgcgcgagttccgcccggcgcacgtcgcggaacgacggggtggtggttacaccgtgcagccgctcgccggagggccgtacactctgtccggtttggccgaggccaacggactgctggtgctcggcgagcgggtcaccacggcggcggccggctcgaccgtggacgtgttgctgctcgaccggaggcgatgaatgctcggggcgacccccggctggcccgctgtgctggcggacgggccggtgttgctgcggccgtaccagcgctctgacgcacgggcctggtccgaggtgcggatcgccaaccagacctggctggcaccctgggagtcggcgccgcccggaccgtgggcggagatgaactcgacccgggcgtacgcgtacgtgtaccgcgacatgcgccgcgccgcccgccgcggggacagcatgccgttcgccgtctgcctgctcgagggcggccgggaacgcctggtcgggcacgtcaacctgggcagcatcgtgcggcgggcgttcgcctcggcgtacgcgggctactgggtcgaccaccgggtggccgggcgcggcgtgatcccgaccgcgctggcgctcgccgtcgaccacgcgttcggtccgggcgggctgcaccgcatcgaggtcaacatccgcccggagaacgggccgagccgccgcgtcgtggagaagctgggcttccgcgaggaggcgtaccaccagcgctacatgcacatcgacggcggctggcgggatcatctggggtatgcgatgaccagcgaggaggtggccgccgagggcggcctgctgtcccgctggaaacgagttcgcagcagtaagtgatcttgagggcgcgagtgccgtcggcgcggcgcgcgaaatatcacggctaccgcccgtaacctcgcattcgtcgtgtcatttgtcgtgtgattgtcgtggcggaacgaaaggggtgagggtgccgacctcggtgctcctcgccgtcctcgccgcggccgggctgctcgccctcgccccggcgctggttcgccggtacgacgccaccgagcgcctcgccgcggaacgggcgtcgtcgacggcgcgggtgctccaacgccagcgccggcgtcgcaccgtgcccggacgccgaccgatcaaccccgggcgccgggttacggttacgctgcccgccccatcgggtgaaaaaccgccggcacccccgcgccgcctgcgcctggtctagctagctagccgcgaacaggctcgccgggccgccgcccgccgcgaggcgcagcgccgcctggccgcccagaaggaggcggtccgccgcgccgccatgggcctcgaccgggaaccctccgacctgccggtcgccgcgaacggcggctcggtcagctaccgccgccgcggcggtctgcgcggccgcccctacgaggccggcggccgccaccacaccgcatgacctgccggaccgtcctacaccgcgccgcgggcgcgggcgcggccggaagcgggatcgtcgcgacccgatcagccatcggcgcttcttcccggggggcggttcgcgaaacggcggggcgacctgttagcctttcggaggttccacggtgacgactcaccgtgagactgaccaggggctgtggcgcagactggtagcgcacctcgttcgcatcgagggggtcaggggttcaaatcccctcagctccaccattacatcgttctacctgctgttatttgatcgacaagatcatctagcccaagttggcattccaggtcacccgccaactgccttccggttggtttcagcaaaccgcttcaacatggtgctgatcacgcttcgtctgcgatcctgtttcggccaccagtgcacgtaggtctcgagcgtcagcttcaagctggcgtgccgtagggccttctgaacctctgtgggctcaaccgcctggtcgatgagcgtcgtcgcgaagaagtggcgtagtgagtggaaagtgccggctgcgggcccttctgcggccttccgccactgcgtccaaagcttggcccaggccttgtcgtggatgggtaggccctgctccgaggtgaatagcagcggaaccgctcgccgagttgggggtcgtccttgatcaggagcgccttctgtgatgtccggaagctggacgttcacgggcgggtgcttgcggatgtgttccgcgatcacgatggcgacctggtcgtcaaggtcgacgtcgccgacggaaccagctttaggtggcttgaggtagaagccgacgtacaccggtgaatgaaattggagctgctgccgcacctccgcaatctggaaaagcgggggcacacccgcctcgctgccggacgcgccctcctgcgccgtggccagataccccacgtcgagtaggcgtgccgcagaacaacatgggggtgcggcgacctcctgatcaaggtcaatgagggtggtcgaccttcgccgtatacatacggctgaactgttctggcttacccggtgtataccaccatgacctgcttctgcgggcggcgtcgcatcgacgctgactcattccgcatgagcggtctagttcctgacacgggtggcacagggtggcgggatcagacaccctgtctcttcctgaccgggtggaggcatgacaagacgttcggccaaggcgcagcggatgggtggctttgcgcttctgctatgggccgcacctgcagtcatcgagccgctcacggtggctttcgcggcgtcggggctcccagaggtcgctgacgcgtcgccgtatgggtgcacggggactgtcgcagtggccgtgttggcttctgtgctgtcgacagtcggagccatcctggcttggcgggggatgtcgggcgctctcaggggtgtgatgtctgctcttctggcggtcattgcggtcctcctgggagtgctgtatttctccttcttcttcagcggtgcgatgctggtcggcttcggcatcttgatgctccacgcgacgatctcggtctgcgtgctcaccggggcagtcctccaggcggctgccgtagtggagagagtcgatcggtgacgcagccggagtccatcaagcgcctctaggagtacacggcgaatgtcggcaagctggcgaaagaacttgtcgagcaaactcctgggtggtcggaaggaagcgatgcaaccggccagcccgatacaggtgggaaacgcggggaaacgatggcaaccgatttgagaacctgcagctcacgaggcctgcgcacctcggagtagcgcacctcgatgcgcacgaagggatcaggggttccaaatcccctcagctccaccattgatgattcacgcagggccggtctgatggccgggcctggttcgtttcccggtcactgtccgcccgggatgctggctatgcggcattgtgcaggtggtagctggcgatttcctcgacgcgggagcggaagatgccggcgcgctgctcgatggccagcggatggctggtcggttcgagctcgatgtacgggggctggccgaccgggcgggtgtgcaccatcgtcttgaggttgagcgtggtggggtcgtagccggggatggcgttggcgagccagccgaaataggggcgctccgtttcgcggcccggttgttcccagacgtcgacggcgcgggtgaagttcgggtggctcagcgaaacccacatgctgtaggtgaagacgtcgccggagtcccagaccgggatctcgatgagcccgcggatgaagaaccgttcgccactgatcacgcagaggtcggagtcgagcaggcagccttcggtgtcggccatgtccggcgaccaggaatccggggccggcgcggcgaagctcagcggggggccgccgtgtgtcgagccgcaggtgccgcacgcgaactcgtcggtgttcatgggcgggaagcatacggcggtaccggtgcgtgatcatcggcacgccggggatgtcacaccagccggacgtcggatcgccggggtgccgtggaaagccgtaccgacgccagcggattcgggcgaaaggtgaatgtcgctacttttgcgtgatacctctgaagcaagtctcggaggtgaccgtaatgaaagcacccctgcccgacaacgagatcgagcggctggccgcgctgtactcgctcgacatcctggacagcccaccggagaaggatttcgacgacatcgtcgcgctggccgccggcgtgtgcgagacgccggtctcgatggtcagcctggtcgacgcggaccgtcagtgggcgaaggccaagaccgggccggatctcaccgagaccgcccgtgacctgtcgttctgcgcgcacgcgatcctcggccgggatctgctgatggtgccggacgccagcgccgacccgcggttcgccgacattccggcggtgaccgcgccggacggcatccggttctatgccggcgcgccgctgatgaccaccgacgggttcgcgctcggcacgctctgcgtgatggacaccgagccgcgccggctggccaccgaacagcagcaggcgctgcgcgcgctggcccggcaggtgaccgcccaactggagttgcggcggtacgcgtatgccctggccaacaccacggcccggctgcaggagctggagcggcgcaaggacgatctggccggactcgtcggcggggagctgcggtcgtcgctgcggctgatgtcgacctatctggagaatctgggcgacaccggctaccacgacatggagctggccgacctggtcgggcgggcggcggcggcgcactgccgcggcttccgggagctgatcgaccacctgacccagatggccgaggccggtctgggcggggacagcctgcacatgcggcaggtggatctgacccgggtgacgcagcgggcggtggaggcggtccggccgatcgcggccagcaagcacatctggatcctgaaccaggccggtgggccgtcgctgccgatcatcgccgatccggtgcggctggagcaggtgttgacccacctgctgttcgcggcggtgaagtacacgccggagggcggccgggtgcgggtcggcaccgagatggagtcgggtccgacggtgcgcctcgacgacatggatctgcccgacgggatgcggcccgacctgttcccgcacctgtactacggcgcgatcgcgaacccggcggacgtgcccgggccggaccgggggctggcggtggccaagcggatcctggacgctcaccacgcgacggtggcgctctccgaccggccgggtgacgggacgtcgctgcacgtggtgttcccgtacgcggacctgaccccggacgagctgatccgcgacctggccgtggcctgaccggaagatcgagaaacccgcgtccccccggctgcagttcggggggacgcgggttcgtttcagtcgcggcgcgacggctagctagctaggtgcccgcccgcccgctcggcggcgtgcccacccacccgttcggcggcgccccggcccgcccgttcggctgctgctgccggggcacctcgggcccggtcggcggccagctctcgaccgccggggccaccgtggtggccacgggttccggagggggcccggacggtgtggtcagaccggcccggtgcagcttgtgccagcgcagccggccgccggtcagcgcggtcgtcgccgactggatcagcaccaggtacatcagctggcggtaggcgaactgctgcagcggcagccgccacagcggtttcagtggctcccggtcgtagcggaacgcgatcgccgcggtgaacagttgcaggctgagcatgccgagccaggcgatcaccgtctcctgcagttcccagaagaccaggccgtagacgagcatgatgtcgacgaccggggcgagcatcggcagcgccaccccgaacagggcgaggaacggcaggccgacgcggccgaagcgacccgacgggccgttgtcgaacagcgcccggcggtgcttccacatcgcctgcatggtcccgtaactccaccggtaccgctggcggtacagctgctccagggtggtcggcgcctcggtccacgccttggcgtgctcctcgtacacgatccgccagccgtcgcggcacagcgccatggtgacgtcggtgtcctcggccagggtctcgtcgctgaccccgcccaccttggcgagcgcctcgcggcggaacgcgccgatcgcgcccggcacggtaggcatgcagcccagcgtctcgtagaggcggcggtccaggttgaagccgatcacgtattcgatgtgctgccaggtggcgaccaggctggcccggttgccgactttgacgttgccggccaccgccccgaccgtggggtcggcgaacggttgcaccagccggcggatcgagtcctgttcgaagatggtgtcgccgtcgacggtgacgatcaggtcgtggcgggccagggcgatgccggtgttgagggcgttggacttgccgccgttgggcacccggatcacgcggacgttcgggatccgcagccgttcgacgatgtcggcggtgccgtcggtggagccgtcgtcgacgaccaccacctcgatctccgggtagtcgccccgggccagggatttgactgccgcctcgatgccctccttctcgttgtaggccggcacgatcaccgacaccgggtcggtgatcggcgggccccagctccatcccggtctgcggcgctgccgggcgtgccggccggcgagcaggagcagcagcgcggtccggccgatggtcagcgcgccgaccacgacgaacagcgcggccaccacggtcaccagcccgtcggcgagccgcaccgtgttgatcagggcggcgccgcgccagacgtcgccggccggggccggcgggttctccggcagcgtcgggatgaccgtggcgctctccgcggcccggcccgccttgacctgcgcggcctgctgctcgatgcccaggttgaggccctcggtgacggtggtgaagcggtatccgcgagccttcatcatcgggatgaatcgggcgagcgccgcgacggtctgcgcgcggtcgccgcccgcgtcgtggaacaggatgatcgccgaggtgtcgccgagcggggtggcgttgcggatgatctggtcgatgccggggcgctgccagtcctcgctgtccaggtcgttgaggatgaccaggtagccggactgccccgcctccttgacgatcttccagttgtcctcgtcgatcgcctcggtcttcgacgagtacgggaaccgggccaggttggtgtgcacgccggtggcctcggcgatcgccacctggttctgcgacagctccaggtgccgccgccacggggcgagcagctgcaggttcgggtgggtgaaggtgtgcaggcccagctcgttgccgtcgtcgacgatgtgcttggtgagctccgggtgccgggcgacctgggagccgacgacgaagaacgtgccgtgcgcgtcgttgtcgcgcagcacctgcaggaccttcggggtccacgtcggatcgggtccgtcgtcgaaggtcagcgcaatggtgcggtccggcaggcggctggtgctctcctggccaccggtggtgttgacgatcggccctccgccgcggatcgccagcggaacgccggactggtcgccgacctcggtctccttgtggtcggcggtgaattcggagttgatgtacgcctgcaccacgagcacggcgacgaacaggccgagcagcagggtgccgagcatgacccgggggcggggcaggatgcgccgccgggtgccgctcacgcctggacctcggagggtgacggtccgggctccgaggagtcgcggcccagcgccgccgccgactccaccggcggtgccggagccgccaccggaggcgcgctgctcggcttcaccggcggcgtcgaggtcgactcgacgggtttgctggcgctggccgacggcgaggcggacggtttaccggcggccggtctggtggtcgtcgtcctgcccgggtgcctggtggcggtggcggcgggccgcgccggaccgggggcagccgggtgccgtgccggccgctcggtcgactccaccggccggctgggcgcggcggacgggccgggtccggcgaccgggctgggccgcggcggcgccgggtcgaccttgtcctcggtgttgtcgatcccgggcagcggcagcacggcgctggacctcaccgggccgccggccaggctgacgctgaccagtccgccgtaggagacgacgaggacgccgaacgccagcgcgatgcgccggagcagccggctccggcgtccggtggagtcgacgaacaccggggccggcgtcgcaacggcgatcacttccgtgtccggaattcgctggtcggcggtctgcgggtgttggtgctcctgcgttgtcacgcggcgagcttaagaacatttatcgcgatcttggcagtcgtcaccttttcgggtgaggatcacaaaacggacaaatcgcgaagccgggaaaaaggaaccgcgcgggtcgcccgggtacccgctggccgcactgcgcggccgaaatacgttacgccagaaccggcggcgaattgctgtcgtattcctgaccagggatttgaaacgtattcacgagaagatatgggcaataagcgagtttagagtaatttgtccgaattgcaagggatggcaatccgtgccgaccgccccgttgtgcggctcatccaggctcgttaagctgcatcttgcgcgcccctatcgcccgcttcccccgtggcaggcgatcggggcgcgccctattttgtggcggatgtccgatcgggatcagcgaaaaaacccatggcgggtcagatccaccggttccccagccacatccgcaccgaccagtcgtcatagggcatcgtcttgccgacgaagatcgggtagaagtacgcgaagcagagcgccaccagcaccacgtaggtggcgaccaccacggtgccgaccagctgccgatcggtgcgtgccggcccgctcaccattccacccggtggcgtcatgatcgccccgaggacgtagacgaccgccaggatcagaaacggcagcccgggcatcaggtagaaggagaacatcgtgcggccgtccttgaccgcgaagtagaaccacggcagcaggctggccatcgcgccggagaagatcgcgtacgcccgccagtcacgccgggcgatgcccagccagaccagcgcgcccagcgcgggcaggaacgaccaccagaggatcggcgtgccgagcagcaggatctcggcggcgcagctggacgccccgcagttgccgttgccgttccagtagaaggcgaccggccggccgagcagcagccactgccacggccaggactggtagacgtgtttctcggtcagtccgctgtggaagctgtacgcctcggagtggtagtgcatcaggttcagcagggcgcccagcacgggcggctcgctgagcccgttggcctgccggtagtgccggaagtagccggtgtcggtgacgaaccagccggtccaggtcgccaggtagaacacggtgctcaggattaggctgagaaccaggtagccgaagtcgccgaggatgccggccacgaagggaccgcggacccgggccgagcggcgggcctgccagcgccaggcggtcaccatcgcggcgaagaacggggcgaagaacagcgcactccacttcaccccgcaggccaggccgaagaagacgccgccggccagcagccaccacggcacgatccgcgggatccggtgggtggtcgccgggtcgaagccggcggccagggcccgttcccagcgtcgccggtaatggtcccggtcgagcaccatgcaggcgaaggtgagcagcacgaacaggccgaggaagatgtccagcagcgcggtgcgcgagagcaccagctggaagccgtccagggtcatcagcagcccggccaggccggccagcacggtggagcggaacaaccggtaggccacccggatcaggatcaggatcatcagggtgccggcgatcgcggcggtgaaccgccagccgagctccttgttgccgaagatctgctcaccgagcgcgatcagccatttgccgagcgggggatgcacgacgtacgccgggccgttggtcttctcgtcccattcgacgccgtggtgcagcatgtcccacgcgtcggtcgggtaatacacctcgtcgaagatgtagcccttggggttgctgaccccggccagccgcagaatcccggcggcgatcgtgatcaccgcggtgaccagccacgaccacgggtcgagccgggtgtccagggttgacaggcgccgcttgatgagggcgggcacgccacgggacggctccgcctcggcggggagatccgcgggggtgaggtctgtctcagctgtcgccgtcgtcaccccgcgatcgtaggctgcctggctttgaagtggagcccgggcgtgtggtggacttttccggtgtctcatgacgaagcaggaccgggccgggtggtgctgaccggcgccccgctgggcaacatcggcgacgcgtcggcccggctgcgcgaggtgctggccaccgccgacgtgatcgcggccgaggacacccggcggctggcccggctggccaaggacctcggggtgagcgtccccgggcggatcgtctcctatttcgagggcaacgacgagcggcgcaccccggagctcatcgaggcgctggccggcggcgcgaccgtcgcggtgatcaccgacgggggcatgccgagcgtctcggaccccgggttccggctggtccgggccgcgctggacgccggctacccggtgaccgcggcgcccggcccgagcgcggtgaccaccgccctggccctctccggcctgcccagcgaccggttcgtcttcgagggcttcctgccgcgcaccggtgccaaccgccgttcccggctgcgcgagctcgccgccgagccgcgcaccctggtgctgttcgaggcgccgcaccggatcgccggggcgctcgccgacctggccgccaccttcggtgcggaccgtccgggcgcggtctgccgggagctgaccaagacgtacgaggagatccgccgcggcaccctggccgagctggccgcctgggccgaggccggcgacccgcgcggcgagatcaccctggtgatcggtggcgcgccggccggcccggcggcccggcccgccgacgacgagctgcgcgcctagctagctagccgccggcgactcacggcgcgacgcgatccaggcggtcgccgacgagtacgggctgaagaagcgggacgtctacaccgtcgtgcacgccccggtccggccggctcagtaggccgccgccaggaacccggccagcagcaacaccggcccgagcacgctggccagcagcgccccgcgccgggcccgcggcgactccagccggcgtgccccggtcgcgccggcgatgccgtacccgcagatcagcaccagcaggaagcccagcgcccagcgcaggtgcagcagcatcccgggcggcccggcgtaggcctggccgctgtcccggttgaccatccgggcgcgggccaccgcaccgggttcgcgggccccgccggagatcccgagcagggtcacccggcgcaccgcgatccggccgtcggcgctggcgaaccgaccggtgcagtgctgggtgaggccgtcgccgtgacagtgcgtggtggtcgcgtacccggggtcgccgtgcccgacggccagccagaacggctccgcgctgacccacgcgaagaacgccgcgagcaggctcagcccgagcagcgcggtcagcgcgccgaccgggtgggtggccgggggccggcgccgcttgccgggccgcgggtcgttgcgggcctcggccacgatccgggcctcgtcggtctgccagaacggcgagttctccatccggtccagccgggtcgcggtcgccggcgagacgccgccttccggcagcggcggcagcggtccgcgcggcggacgctgctggtccaggacaatggtgggccggttgcggtcgtccggctccggcaggatcgccatttccggtacgtcgtcggccgggcccggtcgtcccggctccacgatcatcagctcgccggccgtggccagccgttcgccctgcccgggcgcggtcagccgctgggtggcgtcgtccgcgccggcctcgcgcgcccggtccgcccactccagggaggtcggttcccggtcggtttcgccgcgccaccagccgtccgggggatcggccgcgccccacggctctcccgctggtgttttccctggctgcggcgcgttaccggtcacccgtccagtcaactacgcggcccggcggccggtggcctaatgatcgggcgtgtcgggacaaatcggcagcgcggcaatccgttcgcgagctgcctgggcgggtcactacgcttaggcgtcatgagtcacgttctcgccgcggtcgcctggccctacgccaacggcccgcgccacatcggtcatgtttccggcttcggggtgccgtccgacgtgttcagccggtacatgcggatggccggccacgacgtgctcatggtctccggcaccgacgagcacggcaccccgatccaggtgcaggccgacgccgacggggtcaccccgcgtgagctcgccgaccggtacaaccgggtgatcgtcgaggacctgcacgggctgggcctgtcctacgacctgttcacccgcaccaccacccgcaaccactacgcggtggttcagcagctgttcgagggcctgcacgccaacggctacatcgtggcccgcaccacgctcggcgcgatctccccgtccaccgggcgcaccctgcccgaccgctacatcgagggcacctgcccgatctgcggctacgacggcgcccgcggcgaccagtgcgacaactgcggcaaccagctcgacccggagcagctggtcaacccccggtcccggatcaacggggagaccccgaagttcgtcgagaccgagcacttcttcctcgacctgccggccttcgccgaggcgatcggcgcctggctcgaccagcgggagaactggcggcccaacgtcctgaagttctcccgcaacctactcgacgacctgcagccccgggcgattacccgggacctggagtggggcgtgccgatcccgctcgacggctggcgtgaccgggccgacaagcggatctacgtgtggttcgacgcggtgatcggctacctgtccgcctcgatcgagtgggcccggcgcaccggtgacccgcaggcgtggcggcagtggtggtcggccgacgcccagggcaaggacgcgtccggctactacttcatgggcaaggacaacatcgtcttccactcggtgatctggccggcgctgctgctcggctactccggcgagggtgacaagggcggccaggccggcgcgctgggcaagctcaacctgcccaccgaggtggtgtcgagtgagtacctgacgatggagggtaagaagttctcctcctcgcgccgggtggtcatctacgtccgcgacttcctggagcgctacgacgccgacgcgctgcgctacttcatcgccgcggccggaccggagtccaacgacaccgacttcacctgggccgagttcgtccgccgcaacaacgacgaactggtcgccggctggggcaacctggtgaaccgatcgatctcgatggcggcgaagaacttcggcgagatcccgccggcactcgacctcactcccgaggaccatgccctgctggaggccgccaggaccggcttcaccacggtcggcgacctgatcgccaagcaccgacagaaagccgcgatcggcgaggcgatgaaggtcgtcgccgaggccaacaaatacctgtccgagcaggccccgtggaagctcaaggccgacgcggacaagccgcggcagggcaccatcctgcacgtcgcgctgcaggtggtcagcgacgccaacacactgctgaccccgttcctgccgcactcggcacagaaggtgcacgagctgctcggcggcaccggcgtgcacgcgccgatgccggagatccgcgaggtcgaggacctggacggcggccccggctacccggtgctgatgggcgactacacggtcggcgcccgctgggagtcggtgccgctggtcgccggcaccccgctgagcgcgccgaagccggtcttccgcaagctcgagccgtcggtgatcgaggaggagctggcccgcctcggcggcgacgcctgaccctcgctacgggcagggccgggcgtctgcgccgggccctgctcctacatctggtacgcgagatccgcgatgtggtggtcggccagctcgtcgaccggcgcccacgcctcgtacaccccacgctcgtaacagcgcgcgccggtcgcggtcaacgcctcgccgtccggccgcagcagccgcagccgggcccaggtctcgtcgcgctgcagcacccagcacggcacaccccgccacagggcctgctcggcccgccggctcagggtctgcaccggatagcgggcggcccgggtcagcgcccgcacccggaactcaccgggcgggtcggcgaccgcctcgtactccgtgccgtcgatcgagccgaccagcttcgcggtgccactggcggtgcacggcacgtactcccggtccgggctgaccccgggcaactggtcgagcagcccccgccagcgcgggccggccagccgcagccagccgtgctgctccggctgataggtgtacagcaccacctcgtcgccacccggcacgtacgccaccaactgggcattggccggcagcggcaggtcggcgaagccggccgtcacatactccgggatcaggtcgtcggtgctcggggtgaaaccggtgccgagcaccatcgcaccgacccgcgagtgggccggcagcgcggccagtccgggctgggccggggaggccggcaactcgaaatcggtcgggtcggtggcccgccagcgcagcccgaacgccaccggcccgtccaccgcgccatcggtgcgcagcagattcagctgctccggctcggtcaggtgggcgatgtcacagcagcggtagcagaaaccgtacggcagccagccgccgagatgcccggccacctgcgccggcgacaggatcttcgtcatccgggtaccgcggcgcaccgccgccgtctcccggatccgccgcagcgtggcatcgtcgcggtacaccgcggactgactcatcgactgcacctgctgccaggtcaggtcacggcgcagcggtgccatcagaggtgggtcgagcgggtcggcgcccagctcactgtcctcaccggtcacggtcacgcggcggaacctaagtgatgatggtggatatcggatgaacggtcggttaccggaaaacgcgacgtgcagaatgtctcacatgccttcgagccctgcaccgtcggagaagcgccggcacaaggccgcgcgccgcgccggcgagttcccgcccgccccggacccgctggccgtgccggtcttcgacagccacacccacctcgacctgaccattcaggaggccggagtgcccggcggcccgtccgccgacccggtccaggcgctgatcgaagcggccgccaagaacggcgtcgaccggctcgtccaggtcggcgtcgacgtggactcctcacagtggggagccgacctcgccgaccgccacgatgcggtgctcgccgccgtcgcacttcacccgaacgaggcaccccgcctcaccgatctggacgaggcgctgcgccggatcgacgacctcgccgcccgcccccgggtccgcggcatcggcgagaccggcatggacaccttccgcaccggcgacgacggccgggccgcccaggagaccagcttccgggcacacatcgcgatcgccaaacgccacggcaaagccctgatcatccacgaccgcgaggcacacaccgacgtgctgcgcatcctcgacgacgagggcgccccggacaccgtggtgatgcactgcttctccggcgacgccgccttcgccaccgcctgcgtacgccgcggcttccacctcagcttcgccgggacgatcaccttcgccagcgccggcaacctgcgcgaagccgccgcggtcaccccgcccgaactgatgatggtggagaccgacgccccctacctcaccccggccccgcaccgcggccggcccaacgcgtcgtacctcatcccgctcaccgtgcgtgccctggccgccgcccgcggcatcgacaccgacaccctgtgcgccaccatctcggccaccggcgaccgcgtcttcggaccatggcgccggccggccggaccgcccgcctaggctgctggcatggctgacgcactgctcggcccggcggagatccgggaactcgccgcacgcctcggcgtcgcgccgaccaagaagctcggccagaacttcctgcacgacccgaacaccatccggcgcatcgtggccgccgccgccctgcgccccgacgacgtcgccctggaggtcggccccggcctcggctcgctcaccctgggcctggccggcgccgtcgcccacgtgcacgccgtcgagatcgaccccaccctggccgccgccctgcccgccacggtcaccgccgcccacctcaccgtccacccggccgacgcgctcaaggtcaccggcgaccggttcgacccggcacccaccatgttggtcgccaacctgccctacaacgtcgccgtcccggtcgtgctgcacctgctcgccgaactgcccaccctgcgcggcggcctggtcatggtgcagaaggaggtcgccgaccggctggtcgccggtccgggctccaaggtgtacggcgtcccctcggtcaaactcgcctggtacgccgaggccagatccgccggcaaggtgccccccgcggtgttctggccggtccccaacgtggactccgggctggtcgccttcacccgccgcgaaccacccgccggcgtcccgcgcaccgacgtgttcaccgtcgtcgacgccgccttcgcccagcgacgcaaaaccctgcgcgccgccctggccggctgggccggcggcgccgccaccgccgaacagatcctccggcgcgccggaatcaacccgcaggcccgcggcgaatccctgaccgtcggcgagttcgcggccatcgcggcagcggcgaaaacgtcagagcacggcggtaagctcagcccatccggcgcacagcccgaggaggcgcaagcatgaccgaggcgtggggtccggacgacgacgagccgcgcccgtacagcggcccggtcaaggtccgcgtgccggccaaaatcaacctgcacctcgcggtcggcccgctgcgacccgacggctaccacgagctgaacaccgtctaccacgccatctcgctgttcgacgagatcaccgcccggcacggcgacaccctcaccctcaccatggagggcgagggcaccggcgacctcgccctcgacgagaccaacctgatcatccgcgccgcccgcgccctggccgcccgcgcccgcgtccccgcctacgcccggctgcacctgcgcaagagcatcccgctcgccggcggcctggccggcggcagcgccgacgccgccgccaccctgatcgcctgcgacctgctctggggcctcggcatgagccgcgacgagctcgccgaggtcggcgcccaactcggctccgacatccccttcctgctgcacggcggcaccgccctcggcaccggccacggcgaggcggtcagccccatcctggcccgccccaccacctggcactggaccgtcgccatcgccgacggcggcctggccacccccgccgtctaccgcgagctcgacaccctgcgcgccggcacctggccacccactccgctcggcagcgccgacaccctgatggccgccctgcgccagcgcaacccggaaatcctcggcgccgccctcggcaacgacctgcaaccggccgccctcgccctgcgcccccagctcgccgacgtgctcaaagccggcaccgaggccggcgccctcgccggcctcgtctccggctccggccccacctgcgtcttcctcgccgccgacgccacacacgcccaggagatcgccgacagcctcaccgaagccggcgtctgccgggccgcggtcaccgcccgcggaccccagcccggcgcgcgggtaatctagaccccatcgtggcgaacatcatcaacctggaccgggtcaacaagggctacggggccgccggtcagctgctcaccgacgtctccctcgggctcgacgacgacgcccgcgtcggcatcgtcggcctcaacggcgccggcaagtcgaccctcctgcgcatgctcgcgaaaatcgaggaacccgactccggacgcgtcacccaccgccgggacctgcgcgtcgccgccctcccacagacactcaccctggccgccgacgccaccgtgcgcgacgtcgtcctcggcaccgcctggctcgcccagggcatgggcgccgaacacgaatgggccggcgacgccggcgtgcgcaccatcctcgacggcctcggcatgggccacctcggcctcgacaccccggtcggcccgatgtccggcggcgaacgccgccgcgtcgccctggccgccctcctcgtccgcgacagcgacctgctcatcctcgacgagcccaccaaccacctcgacgtcgccggcgtcgactggctcgccacccacctgctcacccgcaaaggcgccctcgtcgtggtcacccacgaccgctggttcctcgacgcggtctgcaccatgacctgggaggtcgtggacgaacaggtgcacacctacgagggtggctacgccgcctgggtgctcgcccgcgccgaacgccagcgcgtcgccgccgccgtcgaagcccgccggcagaacctgctccgcaaagagatcgcctggctgcgccgcggcccgccggcccgcacctccaaacccaaattccggatcgacgccgccaacgaactcatcgccgacgtccccccggtccgcgacaccgtcagcctgcaacgcctggccaccacccgactcggcaaacaggtctacgacctggagcaggtcaccctcaacgccggccccaagccgatcttcaaagacctcaccttccaggtcggccccggcgaccggatcgccatcctcggcgccaacggcgccggcaagaccaccctgctgcgcctgctcgccggcgtcacccgccccgacggcggccgcctcgtcaccggctccaccgtccggcccgccttcctctcccaggaactccgcgagctgcccggccacctgcgcctgctcgaagccgtcgaagaggtcgccaaacgcgtcaaactcggcgaccgcgaactctccgccggccagctcgccgaagtcttcggattcaccgacaaacgcatctggaccccggtcagcgacctctccggcggcgaacgacgccgcctgcagatgctccggctgctcgccaccgagcccaacgtgctgctgctcgacgaacccaccaacgacctcgacaccgacaccctcgcctcgctcgaagacctcctcgactcctggcccggcaccatgatcgtcgccagccacgaccgctacctggtcgaacgggtcaccgacgcggtgtacggcatgttcggcgacggccgcctcgtccacctgcccggcggcatcgacgaatacctggcacgggtgcacggcacggcaccggccacccgcgtaccggccaatgaaccgcaagcggcgaccgccgccagcggactgaccgccagtgagctgcgccaagccaaaaaagacctggcccggctcgaacgccagatggacaaactcggcgagaaggaaaccaggatcaacgagagcctcgccgagcacggcagcgactacgaccggctcatcgagctggaagcccagctcaaagccgtccgacaggaacgcgaacaggtcgaacaggcctggctcgaactcgccgagcaggtgcccggaaactgatccggggggtgtacctgcgccgcttgtcgcggatacgcgagaatcgggacgacaacacctgaccttggagacggacagcatggcgcatattccggtcaaccaccccctccggccgatgtaccgcctggccggtttcgtcgccggtgcctacctggtggtcttcggcatcatcggcttcgcacagaccgccggcgacaacttcaccggccacaccggcgaccgcgtgctcggccagagcagcaacctgctctggtcgatcatcagcctcgccgtcggagccctcgtcctgctcggcaccgtcgtcggccgcaacgtcgacgtcgccatcgacaaatacctcggctggggactcctcgtcctcggcagctacagcctggccaccatccgcaccgacgccaacttcttcggcgccagcatcgccacggtcatcgtgacctacctggtcggcctgctgctcatcacgatcagcctgtacagcaagaccgccgcacccgacaaggccggcgcgccgcgacaggtccgcgaaggacgcaccgcctgaccccaccgtgcgcctgatggccgcccgcttccccgcgaagcgaggcggtcatcgtgcttcccgggctctccctccactccgcgcgttccgcaagatcagcagggcttgcgggtgatcaggctcggccgcggctccagatgcgacaaaccattccacgccagattcaccagatgcgccgccaccaactccttccgcggctcccgcgcctcccgccaccactgacccaccagcgccaccatccccaccaacgcctgcgaatacaactcggcgaaccgcggatccaacccccgcgaccggaactccgcacccagaatgtgctccacctgatgcgcgacatcgttcatcacactcgcgaacgtgttcgccggagccagcaccggcgcctgccgcgccgacaacacctgaaaaccgtgcggctcctcctcgatgtaatccagcaacgccagcgccgcctgctccagcaactcccgcggatcacccgccgtcaacgccgccgtgatccgctccagcagcgcccgcacctcacggtccacgaccaccgcatacaggccctccttgccgccgaaatgctcatagaccaccggcttcgacaccttcgcccggacggcgacctcctcgacgctggtggcgtcatagccgcgctcggcgaacaactgccggccggtggcgatcaactgctcacggcgctgagcggcggacatccggcgccgcggctccctgtcgtcggtcaccggccaatcctgccaggtccttgtcacgggttcagatattggcacatgtcagcacttacgatcttgcaatccttcgttctaatgtacgtacatgacgacgaaccggttccacagtgaggacgatcggcgggccgaggctcggaaactgcgcgtggacccgggcctgtcccggtcgcagctgatgaaaatgttcggcgtgggcaacggcacgctgaccgcgtggctccagggcctggagtcatccgaatggaccaagcggccgcgggcgaaggacaatctgcgcgagctggcgcgcgacctgcgggctcagggacggaccgtgccggaaatcgccgccgcgctggaggtgtcgaaatcctcggcttacctgtggacgcgcgacatgccactcgacgccacccctgaggaagcggccgcgcgtcgcagtcggcactcgaagtccgttgcggagaagcggtgggggccgcaccggaaggagcgggacctggcgcgcgaccggatgcgggccgaggtgtcgggctgggtcggggatctgtccgagcgggaggtgatcctcctgggctcggtggcctactggtgtgagggtgcgaaggagatgccatgggggccgcgggccacgagcctcaagttcgccaacagtgacccacagctgatcctgcttttcctgcgctatctggcgctgatgggggtcagctccgaacgggtgagtttccgcctcagcatccatgagtccgccgatgtcgagggcgcgacgcagtggtgggcgaaggtcgtcggggtggacgccggagagttcctccgacccaccctgaagaggcacaacccggccaccgtgcgaaagaatgtgggtgacttctatcggggttgcctcatggtcagcgtccgcaagtcggctcagctctactgggagctcgagggcgtcatggagggtattgcgctgagcgaagatcagagtgagcccgctatcatgtgaccggtggacatgacctgagggaaatgtccgaaataggtcccggatcgtctaatggtaggaccgtggcttttggtgccatttatgggggttcgaatcctcctccgggagctttgcgtctgagtctgcggccgggctgacgctggctgcgtcgactgtcgatatcgcctattgcgaacttggagttccaacgtgagccaggcccccagccgtaccgttgtcgtgcttgccgctggtgaaggcaagcgcatgaagtccgccacccccaaggtgctgcagccgctgctgggccgcaccctgctcggccacgtcctggccgtctcggcggcgatccgcaccgaccgcaccctggtcgtggtcgggcacaaggccgacgaggtgggcgccttcctcgccgacgcggcgccggaggcgaccccggtgttgcaggcggagcagaacgggaccggtcacgcggtgcggatcgccctggcggcggcccccgggctgaccgggaccgtcgtggtgctcagcggtgatgttccgctgctgcgtccggagacggtggaggcgctgctggccacgcacgagcgggcgggtgcggcggccacggtgctcagtgccgaggtggatctgccgggtggcctgggtcgggtggtccgggatgcgaaggggaacctggagcgtatcgtcgaggcgaaggacgcgtcgccggacgagctggcgatccgggagatcaattcggggatctacgcgttcgacgcggtgttgctgcgggaggcgctgggcaagctgtcgacggacaacgcgcagggcgaggagtatctgaccgacgtcttcgggatcctggcggcggagggccgtccggtggcggtcgaggtggccgagttcgcgtacgagacgctgggttgcaatgaccgggcggagttgtcgcggctgcgggtgttgatgcgcgatcgggtgaatgacgcgtggatgcggtcgggtgtgctgctgctggatccggcgacgacgtggatcgatgtgacggcgacgttggagccggacgcggtggtggatcagaactgtcagatcctgggttcgtcatcggtggcgaccggtgcggtggtgggcccggattcgacgctggtggactcgtcggtggcggcgggtgcgacggtgttgcggtcgcatgtgatcggcgcggtggtcggtccggaggcgacggtggggccgtattcgtatctgcgtccggggacgcggctggcgcgtaaggcgaaggtcggcgggttcgtggagacgaagaacgccgagttgggtgagggtgcgaaggtgccgcacctgtcgtatgtgggtgatgcggagatcggggcgaaggcgaatatcggcgccggcacgatcttcgcgaactacgacggggtgcggaagagccggaccgtggtgggtgaggcggctttcgtggggtcggattcggtgctggtggcgccggtggagatcgggccgggtgcctatgtggcggcgggttcggcggtggtcaaggatgtgccggcgggcagtctcggggtgacgcgggcgcagcagcgcaacatcgagggctgggtggcgttgaagcggtcggggacggtgtcggcggaggcggcggagcgggcccgggatatcacccctggccaggggtgatccagcgggggtgagtcatcccacgtagtgctgtggaaacatggcggttacgtggccgccagggatacttcatgcgaacccaccccctatccaacgggagcagcgagccgatgggcagcatcgtcgcggagaaccgtaagagtttgatgctcttcaccggccggggcttcccggaactggcggatgagatcggtcaggtgctcggtgtggcgccgacgccgtcggattcgtatgagttcgccaacggtgagatcttcgtccggttcaaggattcggtgcggggctcggacgcgttcgtggtgcagtcggtcaccgagggggtgaaccgctgggtcatggagacgctgatcatgatcgacgcgttgaagcgtgggtcggcgaagcggatcaccgtggtgttgccgttctatccgtattcgcggcaggacaagaagcaccggggccgggagccgatttcggcgcggctggtggcggatctgctgaagaccgcgggggcgaaccggatcttgacggtggatctgcacacggcgcagatccagggcttcttcgacggcccggtggatcacctgttcgcgatggacattctcgcggagtacgtggagaagaagttcgcgggtcgtccgatgacggtggtggcgccggattcgggccgggtgcgggtggcggagcggtggacggaccggctgggtgggtgcccgctggcgttcatccacaagacgcgtgatccgttgaagccgaatcaggtcgtggcgaaccgggtggtcggtgaggtcgagggccgggtgtgcctgatcgtcgacgacatgatcgacaccggtgggacgatcgcgaaggcggcggacatcctgttcgacgagggtgcggcggatgtgatcgtggcgtcgacgcacgcgttgttgtcggatccggcgacggagcggttgaagaacagccggatctcggagttggtggtgacgaacacgttgccgctggcgccggagaagcgactggacaagatcacggtgttgtcgatcgcgccgttgctggcgcgggcgatccgtgaggtgttcgacgacggttcggtgaccacgcttttcggtggcctgagctgatctacagctagtttcacgaggggtgagggcgcccgtggccggcttgtccggtggcgggcgccctccattaatggacccgctgctgtgtgccggtggggagcaggtaagctaatacggttgccacggcgagggtgccccgcggtctgctgaggttcgcagtccgctcgaggctccgtgatcgacgcggtgctccgggcctgtgcccagcgcgcccccttgcccggcagcgccggcgacggctttgacgctgtcgctgatcaccaccgaagcactgctggaataccgcagccgcagacttagacgcagcccgcatcgaagagtttcaggagtttccccgtgtccgaggtaaagatcagcgccgagccccgtaccgagttcggcaagggtggtgcccgccgcacgcgccgggccggcctggtgcccgccgtgctgtacgggcacggtgaggcgccgcagcacatcgcgcttccggcccgtgagttcgcggcggcgatccgtcacggcggtgccaaccaggtgttcaccatcgacatcgccggtaactcgggtgccgtgctggcgctgccgaaggcgatccagcgtgacccgatcaaggactcgtacgagcacatcgacctgctgatcgtgaagcggggcgagaaggtccaggtggacgttccggtcacgctgatcggtgaggccgcgaagaacaccctgatcgtgcacgagtcgaacacggtcgcggtggtcgccgaggcgctgcacctgccgtcggagctggagctgtcgatcgacggtctggaggcgggcacgcagctgaccgccggcgacgtgaagctgccgaagggcgtggagctcgcggtcgaggcggacaccgtgctggcgatcatcaacgcggcgcagagtgtccagacggctgaggaggacgcggctgacgccgaggccgccgaggctgctgcagcggagtaatagcggcgcgggtccgcggtaggccagttcatcagggaaagtgccgggcggcactttccctgatgtgtatccgggaggcggagagggtgacggacgaggcgccgtggctggtggtgggcctgggtaatccgggccgggagtacgccggtaaccggcacaacgtgggtttcatggtggcggatctgctggcgtcgcggctcggggcgaagctgggccgggcgaagcgggcgcaggccgaggccggtgagggtcgtctgggtttcggggggccgaagttggtgctggtgaagccgctgacgttcatgaacctgtcgggcgctccggtggtgtcgctggcgcagttcttcaaagtgcccgtggcgcatgtgatcgcggtgcatgatgagctggatgtgccgttcggccaggttcgggcgaagcggggcggcggcgagggtggccacaacgggctgcggtcgatgtcgaagtcgctggcgagcaaggactatgcgcgggtgcgcttcggtatcgggcggcctccgggccgtcaggacccggcggattacgtgctggccgacttctcctcggcggagcgtaaggagctggatttcctggtggatcgggcggctgacgtggtggaggcgatcgtgctcgaaggtgtcgagtgggcgcagaacaaataccacggaagttgatggttcgggccggtttggcgtgaccgtttgggtcgatttgtacgcctagccataccgtgacggctcagccgtccgtccgttggtcaccacaggcgcacgctttcgatgcgccgccgacgtgacgggaggttcgcgggatgtcgcaggacgtgtccgaaagccgggcggacgcgttgaccgagcccaccgtggaccttccgacgctgcgcgccgatccggtcaaccagggcccgcaagggccgccggtacgccgctcggggctcaacacccggatcccggggccggtcgccccgctgagcccgccgccgtccggggcgtctcagaaccagccgccacgcgcggtgcagggtgccggcgacccgcagcgcaaccaggcgatgagccggcatttcacgacgcgtccgaaccggtcgtcggcgacccgcccgttcatccgcccccgcggccggcacgcggcgatgtcgcgccggcagcgctgggagggccggtacgtgcgcaatctggtgctcggcgacctgtcggccgggatcgcggccggcgcggccgggttcggcctccggttcggcgatcaggtgaccgcgtggaacgaggcgtacctgctggtctccgccatgcttccggtggtgctgctggccgtgctggccgtgtcgcgggcgtacgagcggcgctatctgttcgtcggcagcgacgagtaccagcgggtgatccgcggcgggggcgggctgatcgccggggtggccctggtgtcgtacgccctcgatctggacctggccaggtcctatgtgctggccgcgctgccggcggccgtcgtgtcggtgctggtgctgcggttcgtgctgcgcaagcggctgcactgggcgcgggcccgcggggaggcgctgcgccgggtgatcgtggtcggtcacgagctgtcggtgatcgggatcgcccggcagctgcgccgcgagcgctatcacgggctggaggtggtcggcgcgtgcctgccgccgggcgccgacggcctggaggtggacctgccggtgtacggcacgttcgaggacgtggcggcggcggtggagcaggccgacgcggacaccgtggtggtgctcagctgcccggagctggacggggcggcggtgcgccggctggcctggcggctggaacgcgacgaggtggacctggtggtggccagcgcgttggtcgacgtggccggggcgcggaccacgatccggccgttcgacgggctgccgatgctgcacgtcgagcatccccggttgcacggcgggtcgcggctggtcaaggagctggtcgaccgggccggggcgctgctgctgctgatgctgttcgcgccgctgctgctgggcctggcgctgtgtgtgcggctcacctcgcgtgggccggtgctgttccggcaggtgcgggtcggccgcgacgggcagatgttccggatcttcaaattccgcagcatgtacgtcgacgccgaggcccggctgaacgagctgcggcacctcaacgagcacgacggggtgctgttcaagatgcgcgacgacccgcgggtgaccccgatcgggcgatggctgcgccgcttctcgctggacgagttgccgcagctgctcaacgtcctgtccggccggatgtcgctggtcggtccccggccgccgctgcccaccgaggtggccgcctacgccgatgacgtgcggcgacggctcgccgtcaaacccgggatgaccggcctgtggcaggtgtccgggcgctccgacctgtcctgggaggaggcggtccggctcgacctgcgctatgtcgagaactggtcgctcagtttggatctggtcatcttgttgaggacgatgactgcagtggtgcgttcatccggggcgtattgacgtgagggagcgagactcgtgggcgagcagatcggtgccgagggcggcacaccaccggtgatcgatgccgcgttcgcccgctggctcgccgaccgggccgggcaggagctgctgcgggtccgcgccgaggtgggcttccacgacggcaaggcgctcaagacggccggcgacaaggccgcgcacgacctgctgcgggccgagctggcccggtggcgcccggccgacgcggtgctgtcggaggaggacgagcacgcccgggtcgcgtggcgcgagggggagccggacacggtgcgccccgaccggctcgacgcgtcccgcgtgtggatcgtcgacccgctcgacggcacccgcgagttctccgaggagggccgcggcgactgggcggtccatgtggccctctggaacgcgggcgtgctggccgccggcgcggtcgcgatgccggcccagcaccgcacgatcgccaccgaccacccgccggcgtacccgccgatgccgctggagtcggccaccggcggggcgatccggatcgcggccagccgcacccgcccgccggccttcgtcaccgcgctcgccgaggagctgggcgccgagctggtgccgatgggctcggccggggtgaagatcgccgcggtgatcagcggggaggcggacgcctatgtgcacgccggcgggcagttcgagtgggactcggccgccccggtcgctgtggcgttggccacgggattgcacgcctcccgcgtcgacggcaccccgctgagctacaaccaggccgatccgaagcttcctgacctggttgtttgtcgcaaagatctcgctcctcggttgcttactgcgatcagcaggcatcttccgtcacaatgaccagccggcaacgaccgtggaaaatcgatgagcacagctcggccgaaacccgaaaggtctgggtactgatcccatgagccagacgaaggactatcgcgtctcgcatctggatgcactcgaagcggagagcatcttcgtcatgcgggaggtcatggccgagttcgagcgcccggtgctgctcttctccggcggcaaggactcgatcgtcatgctccgcctcgcggagaaggcgttcgccccgggacgcgtcccgttcccggtgatgcacgtcgacaccggccacaacttccccgaggtcctcgaataccgggaccgccgggtcgccgccctcggcctgaacctggtggtcgccagcgtgcaggaggccatcgacaccggcctggtccgcgagctgcccgacggcacccgcaaccggatccagaccccggtgctgctcgccgccgtggagaaataccggttcgacgccctgttcggtggcgcccgtcgcgacgaggagaaggcccgcgccaaggagcggatgttcagcttccgcgacgagttcggccagtgggatccgaagaaccagcgccccgagctgtgggcgctctacaacggcaagcaccacccgggcgagtcgatccgggtgttcccgctgtccaactggaccgagctcgacgtctggcactacatcgccaaggagcacatcgagctgcccagcatctactacgcgcacgaccgtgaggtcgtcgagcgcggcgggatgttctacgcggtcaacgagttcatccaggtgcgcgacggcgagaccgccgaggtccgccgggtgcgttaccgcacggtcggcgacgcctcgcagaccgcggcggtgctctccgacgccgacacggtggagaaggtgatcgacgaggtcgccgcgacccggatcaccgagcgtggcgcgacccgcggcgacgacaaggtcagcgaagccgcgatggaagaccgcaagcgagagggttacttctgatgagccagtccgttctggagccggacgccgcatccgcgcgcaacatggacctgctgcggttcgcgaccgcgggcagcgtggacgacggcaagtccaccctgatcgggcggctgctgtacgacaccaagacgatcttcgcggatcagctggaggcggtcgaggcggccagcgcgtcccgcggcgacgagtacaccaacctggcgctgctcaccgacggcctgcgcgccgagcgggagcagggcatcaccatcgacgtggcgtaccgctacttcgccaccccgcggcgcaagttcatcatcgccgacaccccggggcacatccagtacacccggaacatggtcaccggcgcgtccaccgccgacctggcgctgatcctggtcgacgcgcgcaagggcctggtcgagcagtcccgccggcacgccttcctgaccagcctgctgcgcgtgccgcacctggtgctctgcgtcaacaagatggacctggtcgactgggaccaggaggtgttcgagcggatcgccgacgagttcaccgcgttcgccgcgaagctcgacgcccccgacctgacgatcattccgatctccgcgctcaacggcgacaacatcgcctcccgttcggagaacaccccgtggtacgagggtccgtcgctgctgcaccacctggagcacgtgcacatcgcctccgaccgcaacctggtcgacgtgcgcttcccggtgcagtacgtgatccgcccgcagtccaccacggtcaccgactaccgcggctacgccggccaggtcgcctccggcgtgctcaagcccggcgacgaggtgatggtcctgccgtccgggctgaccagcacgatcgccgggatcgacaccgccgacgggccggtcgaccaggcgttcccgccgatgtcggtgacggtccggctgaccgacgagatcgacatctcgcgcggcgacatgatctgccgtccgcacaacgccccggccgtcgcgcaggacatcgaggcgatggtctgctggatggacgagagcgccccgctgcgggtcggcggcaagtacacgatcaagcacaccacccgcaccgcgcggaccgtggtgcgcggcctgcagtaccggctcgacgtgaacacgctgcaccgcgacgactgcgcggacggactccggctcaacgagatcggccgggtcaaactgcggaccacggtgccactgctcgccgacgagtaccgccgcaaccgcaccaccggcggcttcatcctgatcgacgaggccaccaaccgcaccgtcgcggccggcatgatcatcgaagcggcctgaccgcccgctcagcggacgatcgcccacaccaccttgcccggcgcggccggcacggcaccccacactgcggcggtgccgtgcacggtccgcaggccccggccccgctcgtccagcggctgacccgctctcgggcgtgtcggccgcagcagccgcggcatcgccgacgacccgtcggcgaccgccaggtgcagaccgtcgccgcgccgggtgaccaccacccggatcggcgtgccggcatgctccaccgcattcgtcaccagctcggacatcaccagccggctcggatgcggcagccgcggcagcccccacgccaggcaggcgtccccggccaggttccgcgccgcgctcggcgcgtccgcgtcgggcgccagcgtcaccgccatccgctcgccgtccggcagccgtccggccaccgccacccgtgcctggcccaccctcgcgtacaccggcagcaaccggccgcccggcacgctgcgcatccggccggcgcccagcccctgcatccggtcggcgagcggcaggtccggcgggacgcacagggccagatgcatcggcggccgcagcgtcgccgccaccgtccgggccgtcgtccaggtcggcacggactcgctgcgcggatcccgcagcccgctcaggtcgacgatcagcgcatccggatgctcggtgaaacaccggagcagtgacgccgacgtcgaccggcgcaggtcgtcaccccacgaaccgcgcacggtcagcaacgacacggccgcatccgccgagaagtcgacacgaaccgacaccgctggcgcgcagtcatcgtcaagatacggtgggtagacccccatgccgcacaccctagcggcgccgcaccccaccgtcgccctctctcgcccctgcgggtgatcccccaaaaggccaggtaggcgggccgaaaggacgacaccgcccggcggtcggagcgtccctggtcgcggtcgtgccgcggagtcaccccggaccggcggtcgtcactgctggtggccgtgcccctccgacgcctcctcgatcgcgtcggtgatcgctccggtcagatcaccggagggcaccgcgatccgctcaccctcaccctcggcaaggtgcgcgacctcgtgcgactccggcagagcgggatcacccgagaagccgtattcgttgggctcgttctccgcggtctcactgccgcgaacatcctcgggcgcgtcgtcggcgggcgagtgctgctcagtcgtcatgcccgcagccatacccgatttccggcaagatcaaaattcaagatcaagttcagattccggacgtcgtgccagggcccacccggagggccgcgggaatcccctggccgagcgatccccgcgcctgcgggaaacgaactcagagcctcccggccccaggcccggccaccgcgacccagctggtcggtgcctcgaacccccgctcggcatacgcccccgcgaccgccgccgcggtggcatcggcgcgttcggcgtcgatcagggccagaacgcacccgccgaatccacccccggtcatccgggccccgtgggccccggccgccagtgcggcttccacggccacgtccacctgcgcgacggtgatctcgaagtcgtcgcgcatcgaggcgtgggaggcggtcagcagtggtccgatctcccggacccggccgtcccgcagcagcgccaccgtgtcgaggacccgctggttctcggtgacgatgtgccgggtccgcttgcgcagcacctcgtcgccgagccggtcgagcgcaccgggcaggccggccacctcgacgtcgcgcagcgcggggacgcccaggatcgcggcggattcctcgcagctcttgcggcgcgccccgtattcgccgtcgacgtgctggtgcggcgcgttgctgttgatcaccaggatggccaggccggcggcggccaggtcgaacgggatctggtcgatccggtaggaccggcagtcgaggaacagcgcccggccggcttcgcagcggatcgaggcggactggtccaggatgccggtgggtgcgccgacgtaccggttctcggcgcgctgggcgatcgccgggcggcgttccagcggcacgtccaggccgccgaggtcgatcagggcggtcagcaccgacgattccagtgcggccgacgaggacaggccggagcccagcggcacctcggagtcgatcgcgatgcgtaccgcgggcggctcgtggccggcgtcgcgcagcgcccacaccaccccggccacgtacgcgccccagccggtcacctcacccggctcggtgaccccgaacgccaccggttcgggggcgagggtggagcagaccgcccaggtcccgtcgggggacgggccgaccgcggcgacggtgcgctgcggcagcgcgaagggcagcacgaacccgtcgttgtagtcggtgtgctcgccgatcaggttcacccggccgggcgccgcccacagcccgtccggctgctccccgtacgcctcggtgaaggccgcgacggcccgggtctcgacgctcatgccacgtgcttgcggtagaaggtccaggcgtccccgatcatcgcctgcagcgtgtccttgcgaggcacccagcccagttcggcgcgggccaggtcggcggaggccaccagggtggccgggtcgccgtcgcggcggggggcggtctcgaccgggatggccgcgccggtgacctcgcgggccgcttcgacgacctgccgattggagaagccgttgccgttgcccaggttgtagatccggtgctcgcccggggtggccgcgtcgagcgccagcaggtgtgcccgggccaggtcctcgacgtggatgtagtcgcgcacgcaggtgccgtcggcggtggggtagtcgtcgccgaacagctgcagcctgtcccgcttgccggcggccacctgcagggtgatcgggatgaggtgggtctccgggtcgtgccgttcgccgatctcgtggccgtcggtgatgtatgccccggcgacgttgaagtagcgcagcgacaccacggccagccggtgcgcgaacgcctcggcggtgagcgccaggtcgaaggtcagtttggtcgacccgtacgtgctggtcggtgccttgaccgcggcctcggtgatgggcagctcgaccgggttgccgtagaccgccgcggtcgacgagaagatcacccgtggcaccgcggcggcccggatcgcgtcgagcagggccagcgacttgaccacgttctcgtgccagtagagctccggtttgaccatcgactcgccggccgcgatgagcccggcgaagtgcagcaccgcgtcgaagccggcgtccggggtgaggaccgagccggcatcggcgatatccgcttcgacgaaggtggcgtccggggcgatcgcctcgcgaaacccggtggccaggttgtcgagcaccacgacctcgtggccggcgtccagcagcagtctgctggtcacgctgcccacgtaaccggcgccgccggtgacgagcagtttcacgggttggcctttctgatggggacggcgaggctagaattccccataagcgctcataagtcaacaggttcgaacatgtccacagggtggccgggtggttcgcggtatcccgtccgagactgacacaatgagcctcatgtccgacgccgtccgccgcccgcgagtgctctccggcatccagccgaccgccgactccttccacctcggcaactatctgggcgcggtgcgcaactgggtggcgctgcaggagacccacgacgcgttctactgcgtggtcgacctgcacgcgatcacgatgggccatgatccggtggcgcttcgtaaccgtactcggatttccgctgcccagttgctggctgtcgggctcgacccggagcgctgcacgctgttcgtccagtcccacgtgcccgagcacgcccagctcgcctgggtgctcagctgcatcaccgggttcggcgaggccggccggatggtgcagttcaaggacaagtcgaccaaggccgggcaggacagcaccacggtcggcctgttcacctacccgatcctgcaggccgccgacatcctgctctaccaggccgaccaggtcccggtcggcgaggaccagcggcagcacctggagctgacccgcgacctcgcgcagcggttcaactcgcggttcggcgccaccttcaccacccccgcggcgtacatcgtgaaggacaccgcgaagatcaccgacctgcaggacccgtcgatcaagatgtccaagtcggcctcctcgccgaacggcatcatcgagctgctggaggacccggcccgctcggcgaagaagatcaaatccgcggtcaccgacaccggccgcgagatcctctacgacgaggtgaacaagcccggcatcagcaacctgctgacgatgtacgcggcgctcaccgcccgcaccatcgacgacctgctggagcagtacgaggggcacggctacggcgacctgaagaaggatctggccgaggtgctggtcgagttcgtcaagccgatccaggagcggacgaagctctacctggacgacaaggcccagctcgacaaggttctcgcggtcggcgccgagaaggcccgggccgtcgccgccgccaccctcgcgtcgacgtaccggaacatcggcttcctcagcccggcccgcggggtctgagccaccgtgggggatcccgcccggacgcgcatcggcgtcgcgatcgacatcccggagccctggggctcggcgctgacccgccggcgtgcggaggccggcgacccgcaggccgcctggacgccggcgcacgtcaccctgctcgggccgaccgaggtggacaccgacgcgctgccgtcgatcgagaagcacctggaggcggtcgccgcggcccagccgccgttcaccatccacctgcgcgggaccggtacgttccgcccggtcaccgaggtggtgttcgtcagcctggcgatgggcatcagcgagtgcgagctgctcgccgaggcgatcaccgggtccgcggagatcaaccggggcagccggtttccctaccacccgcacgtcaccgtcgcgcaggacgtgtcgcccgaggcgctggacgccgtcttcgacgacctggccggcttctcggcccgtttcccggtcgcgtcgttcaccctgttctcgcacggtggcgagggaccgtggcggcctcggcgtgacttcccgctcggcggctgatccgtcggttacggtcgcgcggtgaaccctatcgatcgggcgtatgacgcggtcgcggcccggatcatggcggggcgctaccgctcccgctatttcgaccacctgtgccgtgcgctgctgcgctacgacggggtgcagggcggccggctcgccgcggccagcgcgtactacggcttcttcgcggtgttcgcgctgctgctgatcggctattcgatcttcgggttcctgctgaccagcaacacccagctgttcgccgtggtgcacgacttcctgcggcagaacctgccgttcctggacgtgcaggcgatcctggagagcaagaacaccgtcggcatcgtcggcatcgccgggctgaccttcaccgggatcggctgggtggaggcgatccgctcctcgcagcgccacatctggcaggtgcgcgagcagcccggctatttcggcgtccggcaggccctggacctgatggtgctggtcggcatcctgatcctgctggcgctcacccagctcgccgtctacggcctggagacactgctcgactatctggccgacggcggcttccaggtcaccctgtcggtggtcagcctggtcctcaccctgggggtgaacatgctgctggccgcggcgttgctgggcgcggtgccccggctgcggatgaccgcccgccggatggctccgccggtgctgcaggtcggcatcgggttgatgctgctcaacaccgtgggcaagtccttcgtcgcgacggtgcagcgcaatccggcgtacgggctggtcggttccgccgtgggcgcgctggtctacctgtacgtcttccaccagttgctgctgttcggcgcggcctgggcggcgaccagcccgcacggccgggtggtggacctgtccgctgacgataagaccgcccccgtggggcaaaacctatggatccgggacgcccgcccgcgatgatgtgtcgcgtggggactctcgtgacgctgcgcctgccacccggatcacctctggccgccgtgccgtgggtggtcaccatcgcctcgctcggcgaccgcgaggactgggacccggtggtctgcgggccgtacgagcgggaccacgcggtcgccctggcccgcgcggtggtctccgacgacgacctgatggcggtggtcgagccgatgctgccgctggactcggccgacgcgatccgcaaggagatcgaggcggtccggcaggccgccgaggacgacagcgagccgatcgacgagctgctcgccgagccggccggcagcggaccgcccccgatcaccccggagccggacgaggtgcgcgcgggttggcgccggctggccacccggctgaccgcctgaggccactgcgatactgacgccgtggtgatcacacggcggtgggcggcgttcctgatggcggtcggagtgtggacgtgggtgatctggccgcggttcgggctggccatctaccgcgacgagcggtcgttcgcgcacggctcaccgacggcgtttctgtgggtgcacgcggtgctgatcgcggcgtcgctggtgatcgggtcgaccgtcggggtgctcggggtgcgcgcgtggaacgccgtacgccgaccggagaaagcggccgtgactgaaaagtgaccgcaacctgcggcgaaccgttaccgggcggggttgcgctcggcgaagatttaccaacggtttcccgggcgtcgacgcaattcagcagggaacccaccgaaagcgacgcgcaaaatccctggtgattgcggcgcgataacggtgcgccaacagtccgtaccgaacgcctgacgacccgctgacccacggctacgctgccgacctgagacttaccgagcgtgcggtgagcagtggaaggagggcgtcttgcgcccagtacgtgggaagcggatcgtggcgattctcgcggcaggtgggctgacgctcgcagccgccgcttgtggtaaggcgccggagtcgagcccgtcgtcgggtggcagcgccagcgccgccgccgccgcatacaaggcctgcatggtcaccgacaccggcggcatcgacgacaagtcgttcaacgcctccgcgtgggccggcatccaggccgccaaggccgacgccagcaacgtcgacccgaagtacgtctcctcgtcctccgaggcggactacgagccgaacctgcgcaacttcgcctcgcagaagtgcgactacatcctcgcggtcggcggcctgatgggccccgcgaccaagaaggtctccggcgagagcgcctcctcgcagttcgccatcgtggacagcaacagctccgggccgaacgtctacccgatgcagttcgccacccagcaggccgcgttcctcgccggctacctggccgcgggctactcgaagtcgggcaaggtcgccaccttcggcggcctgaagatcccgccggtcaccatcttcatggacggcttcgccgagggcgtcgcctactacaaccagaagaagggcaagaccgtccaggtcctgggctgggacacggcgaagcagaacggcaccttcgccgacagcttcatcgaccagaacaagggcaagacgatctcccagaccctggtctcgcagggcgccgacgtgatcctgccggtcgctggcggcaccggcctgggcgccgcgcaggtcgccaaggactccggcggcaagatctcggtcatctgggtcgaccaggacggctgcaagtcggccgcgcagtactgcgacgtcttcctcagcaccgtggtgaagaacgtgcaggaggccgtcaaggagtccgtggtcaagggcgccaagggcgagaagctgtcggccaccccgggctacatcggcaccctggagaacgacggcgtcagcctggccccgtacaacaagttcgacagcaaggtcgacgccgccctcaagggcgagatcgaccagctgaagaaggacatcatcgccggcacggtcaaggccgagtcggccagcgcaccgaagtaactcgcgggtagtagtagcattcggccgccgcgcggccgcgggccgatcgcccgcggccgagcggcggctcgcattggaccgcccaccaggttccgtccacgacgtcggggagagtccgctgaaactggaactgcgcggcatcaccaagcgcttcggcgatctggtggccaacgaccacatcgacatcaccgtcgaacccggcgaagtccacgccctgctgggcgagaacggcgccggcaagtccacgctgatgaaccagctgtacggcctgctgcagccggacgagggccagatcctcgtcaacgacgagccgcgggtcttccgcagcccgcgggacgcgatcgcggccggcatcggcatggtgcaccagcacttcatgctcgtcccggtcttcaccgtggcggagaacatcgcgctgggcgccgaggagacccgcggcggcccgctcggctggctggaccgccgccgggcccgccgcgacgtgctggagacttcgaagaagttcggactgccggtcgacccggacgcgctggtcgaggacctgccggtcggcgcccagcagcgggtcgagatcgtcaaggcgctgacccgcgacgtcgacctgctcatcctggacgagccgaccgcggtgctcactccgcaggagaccgacgaactgctcgcggtgatgcgctcgctcaccgagatgggcaagtcgatcgtcttcatcacgcacaagctcaaagaggtcaagaagatcgccgaccggatcaccgtgatccgccgcggtcaggtggtcggcaccgccagcccggacaccagcgaggacgagctggccgccctgatggtcggccgtgcggtcagcctcgaggtggacaagcagccggccgagccgggccggccggtgttgcaggtctccggcctggtcgtcgacgacgaccgggggatccgcgcggtcgacggcgtcgacctggaggtccgggccggcgaggtgctcgggatcgccggggtgcagggcaacgggcagaccgaactggtcgaggcgatcatggggctgcgcgaggtgcgggccggccgggtcgagctcgacgacgaggatctggccgggctgagcaccaagcggatcctgcgctccggcgtcggctacgtccccgaggaccgcagccacgacggcgtggtcaaggagttcagcgtcgcggagaacctgatcctggacatttacgaccgggagccgttcggcaacgccttccgcctcgacctcgccaagatcggtggcaacgcccgggagcgggtcgcccagttcgacatccgctgccagtcaccggagaccgcggtcggcaccctgtccggcggcaaccagcagaaggtcgtcatcgcccgggagatgtcccggccgctgaagctgttcatcgcgtcccagccgacccgcggcgtggacgtcggctcgatcgagttcatccacggccagatcatccacgagcgggaccagggcaccgcggtgctggtggtctccagcgagctggacgaggtggtcgggctggccgaccggatcgcggtgatgtaccgcggccggatcctggccgtcgtctcgccggacaccccgcgcgaggagatcggcctgctgatggccggcatcaccagcggttccgcggaggagaagaagtgaccgcccccacgaccaccgagaagccggtcgcgaagcaggagtcgttcaccagcgccttcctgcgcaacctctggtcgtcgaacagcgtcaccgtcacggtcctgtcgatcgtgctcgcggtgatcatcggcgcggtgctgatcgtcatctccgactccgacgtgctggccaagttcgggtacttcaccgcccggcccagcgacgcgctggacgccggctggacgctgatcagctcggcctactccgacctgctcaagggtgcgctcggcgacccggacgcgttccaggcctggttctccggcaccggtacctggcagaacgcgctttcgccgatctccgagacgctcacctacgccgcgccgctggtgttcaccggcctgtcggtgtcgctggcgttccgcggcggcctgttcaacatcggcgcccagggccaggcggtgctcggctgcatcgcggccggggtggccggcttcaccttcggcctgccgatcgtgctgaacctgatcgtcgcgctggtcgtcggcgtgctcggcggcgccctctggggcttcctgcccggcctgctgaaggcccggaccggggcgcacgaggtgatcaccacgatcatgctgaactacaccgccggactgctcctggcctggctggtcatccagaagggtgtccagcagcccggccgcagcgacgcgatcagcaaggtggtcgccgagtcggcgcaactcccgtcgttcggcggggtgctccgggtgcacctgggcatcgtgctcgcggtgctggtcacggccggggtcgcctggctgctgaaccggtccgcgttcggtttcgagctgcgcgccgtcggggcgaacccgcacgccgcgcagaccgccgggatcagcgtggccaagacgtacgcgctgctgatggcggtggccggcggcctggccgggctcggcggggcgacccaggtgctgggtacggcgtacgcgctgaccccgtcggtggccggcaacatcggcttcgacggcctgctggtcgcgctgctcggccgcaaccgcccgtggggcaccctgctggccgcgctgctgttcggcgcgctgcgcgccggtggcaaccggatgcagtcgttcaccgggatctcgctggaactggtcaccgtgctgcaggcgctgatcgtcatcttcatcgccgcgcccgccctggtgaaggcgatcttccaactccgtgccgcccgcaccaccgcgaagggctgaggacatgtcgaccacgactgtggaggaaccggccgaggtcaccgcgcccgagccgttctggacccggcaccgccgcttcggcgtcgccctgatcctgctcggcgcgctcgccgccggcctgttcggggccctggcgccgagcaaggccgcgcggttcacgctcacccaggacgccggcggcgccgcgctgtcgatcaacggccaggtcggcgcggtgctgttcggggtgctcaccctggtggccggcggtctgctggccgccgggctgctccggcgctgggcgaacgcgttcctggtgatcggcatcgtcaccttcgtgctgtcgttcctgtgctggcaggtcgccgggcagttcatgtcgctgcaggacaccctgggcggcacgctggacctggcgctgccgctgatcctgggcgcgctggccggggtgctcggcgagcgctccggcgtggtgaacgtggcgatcgagggccagttcctgatgggcgcgttcgccggggccctggtcggcaccatggccggcagcgtctgggccggcctgatcagcgcggccgtcggcggcgtggtcatcgcggcgatcctggccgtgctgtcgatccgctacctggtcgaccagaccgtggtcggcatcgtgctgaacctgttcgcgctcggcatcaccggcttcctctacgagcggctgatgcagcccgacgcggcgaagtacaactccccgccgcagatgccgacctggcggatccccggactggccgacatcccggtgctcggcccggtggtcttcgacgccaccctgctgctctgggtcgcgctgatcctggtcgcggtcatccacttcgcgctgaaccggacccgctgggggctgcgcacccgcgcggtcggcgagcaccccaccgcggcggacacggtgggcatccgggtgcgcggcctgcgttacctgaacgtgctgctcggcggcgtggtggccggcctcggcggggcgtacttcacgctggtggcgaccggcagcttcaccaagaacatgaccgcgggcgccggcttcatcgcgctggccgcgctgatcttcggccggtacacgccgatcggggcgttcggggcggcgctgttcttcggcttcgcgcagaaactcgcgttctacctgagcgcgatcaacagcccggtgccgaaccagttcctcagcatgctgccgtacctcgccacgatcatcgccgtggccgggctcgtcgggcgggtccgcgcgccggcggcggacggcatcccgtacgtcaagagctaggttttccggtggttcaagatgcccgggcctggcccgggcatctgtcgttgaccgacgaaacagtggggcagaatcgagatcatggagatcgactgggcggcgctacgagcagccgccatcgaggtgatgcgccgcgcctacgtgcccgcatccgacttcccggtcggcgtcgccggcctggtcgacgacggccgggtcatcgtcggctgcaacgtcgagaacgcctccctgggcatgaccctgtgcgcggagtgcggactggtcagcgccctgcacgcgagcggcggcgggcggctggtggcgatgtcctgcgtggatgccaccggcgcgccgctgatgccgtgcgggcgctgccggcagctgctctgggagcacggcgggccggacatgctgatcgaggcgctgccccggccgctgcggatggacgagttgctgccgcacgcgttcggctgggtggacatggccaaggtcaccggcccggccggcggcccggaggtgccggccgagctcgccaagtggcgcggtcggggcaccgtcttcgtgcacccggacctgtccggcggggcgacgatctggacggcctactgggagcgctcgtcgggcgccccgggcaccggcgaggagaagggcatcctggaggaggggccgaacttcccggccgcctcggccgcggtggcctggggtctggtccgcagtccgcgggtcgtggtggtggatgccgagggcggactgtcctgggcgggcgagggagagctgccggacggtattccgcagcgctggaaggacgaggcatgagcgggatcactgcggtagacgtcatccgggccaagcgggacggccgggcgctgtccgacgcgcagatcgactgggtggtcgacgcgtacacccggggggtggtcgccgacgagcagatgtccgcgctggccatggcgatcctgctgcgcggcatgacggccgccgagatcgcccgctggaccgccgcgatgatcgccagcggcgagcggctggacctgtccccggtgtcccggccgaccgccgacaagcactccaccggcggcgtcggcgacaagatcaccctgccgctgaccccgctggtcgccgcgtgcggggtggccgtgccgcagctgtccggccggggcctcgggcacaccggcggcactctggacaagctggagtcgatccccggctggcgggcccggctcggcaacgacgagttcatcggccagctgcgcgacatcggcgcggtgatctgcgcggccggcgagggcctggccccggccgaccgcaagctgtacgcgctgcgcgacgtgaccggcacggtcgaggcgatcccgctgatcgccagctcgatcatgagcaagaagatcgccgagggcaccggcgcgctggtgctcgacgtcaaggtcggttccggcgcgttcatgaaggacctggccagcgcccaggagctggctcggaccatggtccagctgggcaaggacagcggggtcaccacggtcgcgctgctcaccgacatgagcaccccgctcggcctggccgtcggcaacgccaacgaggtggccgagtcggtcgaggtgctggccggcggtggcccctccgatgtggtggagctgaccctggccctggcccgggagatgctgtccgccgccggggtggacgccgacccggagaagatgctcgcctccggcgccgcgatggactcgtggcgggcgatgatccgcgcccagggcggcgacccggacgcgccgctgcccggcccgcggcacaccgaggtgctccgcgcggccgccgacggcgtggtgaccacgatggacgcgtacgggatcggggtcgccgcctggcgtctcggcgccggccgcgcccgcaaggaggacccggtcagcttcggcgccggggtgcagctcaaggtcaagcccggcgaccgggtcaaggccggtgacgtgctgctggaactgcgcaccgacgacgaggggcggatcccggcggcccgcgccgatgcacaggccgcgatcatgatcgggaccgatgcccccgcctctgccggtctgctgctggaccgcatagcctgaggcaccatgacgaaggccgctcccgatccccgcgcggttcgcgaggccagcctggacgagttggcccggctggatctgccgctgccaccgccgtccttcccgctggtctgggagctcggcgacacgatagagctgcgcccggtcgccgagctggaggcccgggccgcggtgctgcacgtggtggtcgcgcggtgcttcgggatgcccaccgaggcggcgatgagctggctgctcagctcgcacctggtcgacctggtgacgccgccggagtggcagttcgtgatcggcgcgaagggcgaccaccggtcgttcgtgctgcaccacgacgcggtctttgcgctggcctggctgctcgggctgggccggcacctggacccgaccgtcccgccggacgacaacctgatgagccagatgccggacctgccggccggggagcccttcggccggtggcggtcccggtcgctggtcgcggtccgcgacgccgccgaggccgccgtcctgctcgacctgtactactgcctggactgggcgttccaggaggccgagcaggccgggctgccgctgcccggtgaggtggacagcaacgcgatcgggcagcgccggtgggcactggagtgggcggtcatcttccacgggccctaccacgacaaaccgccgggctgggaagaggtcgatctctcggtttaaggctttcgggtgtacgtcgtgagcaccaccgccgcggtcaccgtgacgtcgcgggtgggcagcgactcgaccgggacgtgccgggcgctcggcgtcatcccgatcagggtgcgggcggcggccgcgtccagccgcatcgtgtgccggtgcgtggtggcgccgaccggccggaaatgatcgtcgaggctgccgctgacccgggccgccttgtccgggtcgacccgcagcaggccgtgctcgtcgaccagctcgcgcaggtggtcggcggccggggtgaccaccagcagccggccgtccgggcgcagcacccggtggaactcggagccgttgcgcggggcgaagacgttcaggatcacggtggcggcggcgtccgcgaccgggagcgggcgccacaggtcggccaggacggcggcggcgcgcgggtgggcgcgggcggcccggcgcagcgccggcttggacacgtccaggccgacgccgagggtggtcgggcaggcgtccagcacgtgggcgaggtagtcgcccgtcccggtgccggcgtcgaggatcagcggctcacggcgtacgccgagctgatcctgatcgtgaatgtcccggtggtccgcggtggtggcggccagggcctcggcgatgaagcggtagtgaccggcggccaggaaaccggcccggtcggcgatcatctcggcgctgtcgccggtgtgcggcagccggcccgcggagagatccacgtaaccctgccgggccatgtcgaagctgtgcccgagcgggcagcgcagcgcccggtcgtgccgggccagcgtcccgcggcacaccgggcaggtcaggtacggcaacgcgccatcgatcatggggagattttccgctccgttttccgggtggtgggtgggacggccggaccggcctctacgctcttctgatggctggcatcgcttaccccgagatcgtcaaggctcccaaggtcctgttgcacgaccacctggatggtggcctgcgtcccgccacgatcgtggagctggccgccgtggccgggcacgagctgccggagaccgaccccgaccggctgggtgagtggttcgccgccgccgccgactcgggctcgctggaacggtacctggagaccttcgcgcacaccgtcgccgtgatgcagaccgtcgagggcctgcaccgggtggcccgcgagtgcgcgctcgacctggccgccgacggcgtcgtgtacgccgaggtgcggtacgccccggagcagcacctggagcgtggcctgagcctggacgaggtggtcgaggcggtggacgccgggttccgcgacggctgcgccgaagcggccgcccagggcaccccgatccggatcggcacgctgctcaccgcgatgcgccacgccgcccgctcgcaggagatcgccgagctggccgtccgctaccgcgacgccggggtggtcggcttcgacatcgccggcgccgaggccggcttcccgcccacccggcacctggacgcgttcgagtacctgcagcgggagaacttccacttcaccatccacgccggcgaggcgttcggcctgccgtcgatctgggaggccatccagtggtgcggcgccgaccggctcgggcacggtgtccggctgatcgacgacatcaccgcgacggtggccggacccagctcggtcaccccgaccggcggcacccacgcggcgccgccggtgctcggccggctcgcggcgtacgtgcgggacaagcggatcccgctggagctgtgcccgtcgtcgaacgtgcagaccggcgcggccgagtcgatcgccacgcatccgatcaagctgctgcacgacctgcgcttccgggtcaccgtgaacaccgacaaccggctgatgagcggcacctcgatgagccgggagatgagcctgctcgccgaggcgttcgggtggggctgggcggagatgcagtggttgaccatcaacgcgatgaagtcggcgttcatcccgtacgacgagcgattggcgctgatcaacgaggtgatcaagccggcgtacgccaagttgctcggctgaaattcgtacaaatcaggaaatttgctattttccgggaaacgagcgaacgtacgtctggcgaaattacctgtccggttctggggctccaccgttcggctacactgccgcctacaaagacggcataatccggcatttgccttgccgatcccggggtcggcgagtcatcgtcagtcctgtcgcgatcgactacgatctgacccgtcggcctgcgcccaccccccaacgccgcgccgacctcgtgagtgaccttgagaaacccgcaccgctacaggtagtgatttcagaccggcgatgtccaactacgacgttgcaacatcgcgtcacacaaccggtccgtgtccgcctgctctttctctttgacactcgtcgtgatggaatctcgggggcccgacccggcgagtcggtcgtgcgcggtgcccggcgagccgaatgccgggcccgaatcaggaggacggtgacgtgagcaagcgccctagtgaggcggacggcgtcatgtcgcgtctgcgtcgacccacgggtcggctgcgagacctacccatctggtccaagcttggtctgatcatgcttgtgccgaccgttgcgacgatcatcgtcggtgtcaacggcctggtcgagcacatcgaccaggccgacaccgcggacaacaccaggacgctcgccacgctggcccaggcggccggcgggctggtcgaccagctgcaggacgagcgggcctacgcgatgcaggtggtgctcgcgcccaagtcgcccaagggcaacgaggtgttgaccgccgccaccaagaagttcaacgacgagcatgccaaggtcgaggcggccaaggatccgtacgcgcagcagcgcgcggccctggacacccagcccgaccgggtcaacctgctgctctcccggctggaccacaacctggccgacctcgcggcgtaccgcagcaaggtcaccaacaacaccgagaccgagctcagtgttcagggcacctacaacgcgctgatcaccgacctgctcgcggtccgggacgtcgccgcccagcaggccaccgacaccggcctgagcgaccacctgcgcgcggtcgccgaggtggcccgagtcaaggagttcgtctcccagcagcggttcatcggcctccaggtgatcgccggcggcaagttcagcaccgcgctccggcaggccttcctcaccgccaacaccggtatcgacctcgccgagagaaacctcaaggcggcggccaccgacggtgagaacgaggtcttcctcaagaccaccgaccagaacgaggcgcagcgcgccgcgacgaacctgaccgagccgctgcaggccaccccggggaccgacatctccaacctgcacctcaccgcggccgggtgggactcggcgatggccggctacgacgacacgttccggcaggtcgagcagcagctcgacaagaacatcgtgaaccaggccaccgacctgcggaacaccaccaaccggacggtcttcgtcgagaccagcgtgctgctcggcatgctgctgctcgccatcctgttcgcctggctggtcgcccgctcgatggcccgctcgctgcgtgagctgcgtcagggtgccctggcggtcgcccagttcggcctgccgcacgcggtgagccggctgcgcgacccggcgctgtccacctcgctcaccccggcgcaggtcgccgaccagatcgccgagccgctcccggtccgcagccgggacgagttcgggcaggtgaccgaggcgttcaacgcggtccacctggaagccgtgcggaccgcggccgagcaggccgccctgcgggcctcggtcgcgaccatgttcgtcaacctcgcgcgtcgctcgcagatcctggtcgaccggctgatcggtcacctggaccggctggagcgcggcgaggaggacccggaccggctggccgagctcttccagctcgaccacctggccacccggatgcgccgcaacgacgagaacctcctggtcctcgccggcgcggactccacccgtgtgcagcgcgagccggccgctctgatcgacgtgctgcgcgccgcgcagtccgaggtcgagcactacacccggatcgagttcggcgtcatcgaccgggagatcgaggtggcggcgcacgccgtcaacgacatggtccacctggtcgccgagctcttcgacaacgccaccgccttctccccgccgaactccaacgtgctcgtcgaggcgcgccgggtcggcgagaccgcggtgctcaccgtcgaggaccacggcatcggcatcagccgcgagcagctgcgcgacctcaacgagcggctggccaacccgccgaccgtggacgtggccgtctcccggatgatgggcctggtcgtggtcgcccggctggcgaaccggcactcggtccgcgtcgagctccgcccagccgaccgggaacggggtactgtcgctgaggtgggcctgcccgtcaccgtcctcgctgccgcggtctccggccggatgggtggctacgacgcgccgccggccgcgatgccgtcgttcggcgagcccctcgccctggaaagcggccgcgggggatacccgggcgtcaacggcagtgccaacggcagcaccaacggcggggtcccggcctggtccgacctgaccggcgcggcgccgtccaacggcttcggcgggaccaacggcttcaacggcggtcccaccggcttcggctcggccaacggtttcggcgccacgccgagcggcttcagccccccggcgaacggtttcggcgggcagaacggtagcggcccgaacggtttcggtggacagaacggcttcggcggcgcgccgaacggcttcggtccgcgcagcaacgagccgatgcccccgctgccgtccggcccgaccagcagcggcccgcagggtttcgccggtctcgacgagctggtccagcggcgcaacggcaacgactaccagcggcccgacggggagaccggcggcttcggcgcgaccattccgcgccagctcccggccaacccggaaagccagggccggtcgtcgttcatgccgccggtctcggcgccgccggtgccgtcggccccgccggtgacctcggccccgccggtgccgtccgcgccgccggtctccgccgccccgatctcggccgagcccacctcgttcgcctccgcgccgccggcctggccgccggtcgccggcgaccgcgagaccgccactccgcacgtcccggagaacctcgctgcggcgctcgacatgaccgccgagatcccgaggtaccgcccggacaccgccgagcagcgccccgaggtggcccggccgatcgacccgccgctggcatccctgcccgcgtcggccccgccggcgtacgaggcgatcgccccggtcagcggcccggccgccgaccaggccaccgcggccgcgcagatctcctcggcccgtgagggcgcggtgccgttcgccgacgagacgatggagctgccgatcttccgcgagctcgagtcggcctggttcaccacgacccaggcgacggccgccaagccgtcggtggccggcacgggcgaggaagcggtgatctcgcagcggatcccgaccggcgagcccaccacgcgtaccgccggggtgccccagcaggcggcctccccggaggcccgcgagctggacaccgcgtccgtcggcgcggctcccgcggctccggcggccgtcgccgccgggtcctacgccggcaccccgtcgaacccgtggcagaccgcggccgacgagggctggcaggccgcccgcaaggcgtccgaagtcagcatcgacacgaccaccacggcgggcctgcccaagcgcacgccgatggcgcaactcgtccccggcggtgttgaccggggcggtaactccgtccagcgccgtactcccgaaggggtccgcggtctgctgtccgcgtaccaccggggtgtgcagcgcggtcgcaccaaggaacaatcgaccaacctggaggagactccgggagggcagcagccctcgcaggctggcaaggagcatgaggcatgacatctacgcaggatctcggttggcttctcgccaacttcgctgaccgcgttcccggggtcgcgcacgcgatcgcggtctccgccgacggcctgctcctggcagcctcgcgggatcttccccgggaccgtgccgaccagctcgcggccatcgcgtccggcctggtcagcctgacccagggcgccgcgcggtgcttcgagggcggcgctgttctgcagacggtggtggagatggacaatgggttcctgttcctgatgtccatctccgacggctcctcgttcgcggtactcgcggctcgcagctgcgacgtcggtcaggtcggctacgaaatggccctcctggtcgaccgcgtcggcgaggcgcttacccccgcgccgcggtccgcggccggggtgctgggctgaaggcgcggtgagccggcccatccggctactgtccaaaatcttgagaaccaatacacttcgagtggccgagggaggggttgacggtgacgatgccggagcgtgatgaaccgaccggatcgctggtcaggccgtacgccgtgacccgcggtcgaacccggccgaaacttgagatagcgctggaagcgctggtcgagacaaccgtacgcggccgatccggaatgatccgcagcggacagggtggaagcgagcatcagtacatcgcggcgatgtgcgacaacggccgagtgcagtcgctcgcggaaatcgccgcacgcatgcaactgccgctcggtgtggcacgggtgatcgtcgcggacatggcctccgacggcctgctcgcggtgtacgagcccacctcgctcgaggacgagaccgacgcggtaggcacggaactgctggaaagggtgctgagtggacttcgcaggctctgacatgtcgcaacgtcccgctgcgggcggacgcgtgacatcggcgaagattgtcatcgccggtggcttcggcgtcggtaagacgacgctggtggggtcggtctcggagatcaccccactgaccaccgaggcgatcatgacttcggccggtgtgggtgtcgatgacaaccggcaggtgccgggcaagatgaccaccaccgtggccatggacttcggccggatcagcatcgaccgggacctgatcctgtaccttttcggcacgcctggccagacgcggttctggttcatgtgggacgagctggtccggggcgccatcggtgcggtcgtgatggtggacacgcgtcggctcgccgactgcttcgccgccatcgacttcttcgagcaccgccgcctgccctacctggtggcgatcaactgcttcgacggcatgcagtaccacaacccgcaggacgtccgggacgctttggcgatctcgagcgacgtgccggtcgtgagctgcgacgcccgcaaccgcgagtcgacgaagaacgtcctcatctcgctcgtcgagtatgtgctgacgatgcgtcggacgcgcgcggtggcgccggcctgacagtcggttgagccccgctccgctcggcggagcggggctttcgcgcgcttgcggacaggtcttctccgcagccgatcaacaacggtgagtagtatccgccgcctgccgcctgccgcctgccgcctgccgcctgccgcctgccgcctgccgcctgccgcccgccgcccgtgccctgcccgtgcttgtgcctgccgcccggggccctgcccgctagctagctagatgacgaagccgagcccacccgggggaggactcggcttcggtgatgctcaggaccgggtcagcggccgccgccgtagcccgccccgttgcggtactcgtcggcgccctcgcggtcgcgggtgaagtcccagccgccggcggcctcgcggcccgggcggccgcccatggcgaagccgccgatctcctggccgcgccgccaaccccggaagtagccggtggtgtgcgccgcgatcgatgccgcgtcccggacgatgcgcagcgggcgctcgtcgcggaccgtggcgccgggcaccaggttggcctgggggacccgcttcggcagaccggccgaggtttccgcggcgacggccggggtggccgccttctccgcggcgcgccagccgctgtcgttcgggttggcccagtcgacattgccggagtcaccggtgctggtgccgccggtgaaccaggccgaccgggcggccgcgaagatcagcaggtcgccgtcgctgccgtcggacggcaccggcggggtgctgctgcggtccagcgcggtgaccttcggcgggaggctgtcgacgccgcgggcaccgccgtcgaccacccgcagcgagggcggatcaccgagctggtcgagcccgggcagcttggcccggccgccgccgttgagctgggactcgaccaggcgcagggcgggcggttccttcggcatgtcctgccacgggggcctgatccggccgtcggcaccggccccgctcaccgaggcggcgggcagcgcggcatcgtcgccgccgttgttcagcagcggccagttggcccgcgagcccggctccgcgctctcggcgccgggacgctgggccggcatcggcagggcgaagtcggtgggtccggccgccgcgccgttggtggcgggggacggggccgccgaccgggtgctgggccgggccgggatgaccgtgcgctgccgctcggcccgggcccggttcagctcggcgttggtgagggtgggccggaacggctcgcccgcctcggccggggtcggggtgccacccggcgagaccgggttgcgagcggccggcgagaccggattgcgcgcggccggcgacagcggagccgaggacggcgccggtgacagcgggctgcgcgcggccggcgagagaccacccgacgtgccggaaaggctcgaagtgccggaaaggcctgacgtgccggcgaggcccgacgtgctggcgaggcccggcgtccggcttcccggcaccggccgcgaacccggcgtgatcggcgtcatccccggcggaggcggcggcaccgacaccggccggttgcccggcgtcgagacccgtcccggcagcccgttggccgcggccggcgccaccggcggcggcgtgatcggatcgggagcgaccggcggagcgttcatcggccgcggcgtcgccggcccgttgccctagctagctagccacgttcggctcggctgccgggccaccggaccgggcggcgagcgtgccgaccagcgcggcgcagccggcgtcgcaggtgcgcaccgcggcgatggcgtgccggaccgcctcggcggcggccggggccagtgacttgttgacgccgccgcggcgcggcgactcgctgatcgccacctgcagtgcggtgatgaacgagaagatctggtcctcggagccgacgccggcccgggtgagctcggcggcgacctcctgcgcggcgtgttccgggtcgccgccgcggccggtcagccggccgggctcggggatcgcctcgaggacggccatggcgatcgggtgcgccgggtccggataggcccgcagggcggccgggtacagctcgcgcagcacctcgcgcagcgcggccgcggccgcattgcgcccgaccagcatggccacgtgcgcggccagcaccggtttgtagctgaccagctcgcgcggggcgggcagggtgaccgcggcgatcgccccggcctgcagggcccgggccagcccgactgcccgccgggcggcggccggggcgttgatctcctcgggggagtcgtcgtccgagaagcgctcggcgaagtcgtccgcgtcgtcgtcgtcgaccacgaccagcggccggccggcggcggtcagcagcgacgtgacgacgtggtcgtcactgtcggcggccacggccgcgtcgctgaaccccgtcgtacgttccacgagcagcgttcccagcagggcgtaaccggccgggtcgtcgctgatctcgtggacgccgagcagccggcctgcgtcgtccaccacggcgatggtcagtggagcggccgtggccgatcgcaccgcatcatcagccgacgccagaccgcagtacacgcgcacgagcgccacggcgtcgtcctcctccccgggagtgcttctctgtggccaaggactgatgttccctggtaatcggtcagtcacgccagtccacagcagcagagatcttgccgatcaccgaacgccagccgagactcgcctgttgtgccccgattttcttcagccggcggcgcccgaagaatccgcccatgccaccgttctgcgcggtgcggagggactcgtcgaggtcgtcgagcggggaaccgggcgacagggccaggatcaccggcttgagccgaagcgcgtacccgaggtcacgggccacctcgccggcggcgatgagcagcggcagatcccaggtgtcgtgcccgccgcgcaggttctccaccacgaggtcgagttcgtaacgctcctccggcagcgggtcgatgtcgctcgactgtacccgctcggccagggcaccccaggtgtccaattgtgcgagatcgtggggagcacccgaacgaatgaaggagaccagcgactcggcgttcttgaaggcgagcaaccggcccttgtggctgaggaacatgggtacttcctcatcgtccggctgggtgctcgcctccgccgcctcgtcatcggactcggccttctcgtcggaagccgtctcgtcctcgtcgtcaccctcggcgagcagcgcctcgtactcctcgtcgacgatcacgccctcctcgccgtcctcgtcgagggcggcgcgcttgcgcgtgtcgaacgggtcctcctcctcggcctcgatctcggtcggggtcagctcggagaccgaccggtaggcgcggagggtcaggcccacgccgcccgggagagcgatctcgaccggctcgacacggacttcgtcccagagctcacgcccgttgagcccctcggcttgggacttctcggccaccggcgcggacgcctcgggctcgtcggactggctggtcacggttgacctccgggttgatctgggcgggacgggtgactacgggcacataccctagtccgcaacgctgtgtgacagcggccccgccccgtcagtagcccttcgggtgccagaccgtcttcgtctccagtaacgacgtcatcggcttcaggcccgggtcagccaggaaatcaggctgctccgcggggcggatcacccgcttgagcgtgccggcggcggtgcgttcgagttcggctgccaccgagggcgcggcgccggtgaggtcgacggcgttgacgtcggcgtgcgcggccagccacggggcggtctcggcgtacgccccggtcaggatgttgaccacgccgccgggcacgtccgaggtggccagcacctcggccagggtgatcgcgatctgcgggtcggcggccagcaccacggtcgtgttcccggtcacgatcgccggggccagcacgctgaccagtccgagcaggccggccggcgcgacgacggcgaccaccccggtgggctccggcgcggagatgttgaagaacggcccggccaccgggttcgccccgccggccacctgggcgatcttgtcggaccagccggcgtaccagatccagcggtcgatcgcggcgtccacctcggccgcgggcacgccgaggccggtgaactcggcccgccgcgcctcgaccatctcggcgatccgatacaggatctgaccgcggttgtacgccgtggcgccggcccacccgggctgtgcggcccgggccgccaccaccgcgtcgcgggcgtccttgcgggaggcgagggccacgttgtcgccgtctgccacgaacgtccgtcctgattcgctgcgcgggaacttgccgccgatgtagagcttgtacgtcttgcgcacggtgagccggggggtcgccgccggctccacgagcttcgctgacttaggcaaggtacgcctccaggccgtggcggccaccctcgcggccgtagccggactccttgtagccgccgaacggcgacgccgggtcgaacttgttgaacgtgttggcccacaccacgccggcgcggagtttgtcggcgaccgccaggatccgggaacccttctcgctccagatgccggcggacaacccgtacggcgtgttgttggccttctcgacggcctcggccggggtgcggaaggtgagcaccgacaacaccggcccgaagatctcctcgcgggcgatccggtgggcctgggtcaccccggtgaagatcgtcggcgggaaccagaacccgcggtcgggcaggtcgcaggccggcgaccagcgggccgcgccctcctgcgccccgatttccgacaactccgagatgcgggccagctgggccgcggagttgatcgccccgatgtcggtgttcttgtccagtggatcaccgacccgcagcgtgcccatccgccgcttcagcgactccagcagctcctcgaagatcgactcctggaccagcagccgcgacccggcgcagcacacgtgaccctggttgaagaagatcccgttgacgatcccctcgaccgcctggtcgatcggcgcgtcgtcgaacacgatgttcgccgccttgccgcccagctccagggtgagccgcttgccggtgccggccaccgtgcgggcgatctcccggcccacctcggtggagccggtgaacgccaccttgtcgacgtccgggtgggccaccaggtaggccccggtgtcgccggccccggtgacgatgttgaccaccccgggcggcagctcggcctgccggcacacgtcggcgaagaacagcgcggacagcggggtggtctcggccggtttgagcaccacggtgttgccggtggccagcgcgggcgcgaccttccacgcgagcatcagcagcgggaagttccacgggacgacctgcgcggccacgccgagcggccgcgggtcggcgccgaacccggcgtagggcagcttgtccgcccagcccgcgtagtagaagaagtgcgcggcgaccagcggcaggtcgacgtcccgggcctccctgatcggcttcccgttgtccagcgactcgagaaccgccagctcgcgggaccgctcctggatgatccgggcgatccggaacaggtacttcgcccgctccgccccgggcagggcggaccaaccggtgaaggcgcggcgggcggccgccaccgcgcggttgacgtcctccggaccggccatggcgacctcggccagcacctcctcggtcgccggattgaccgtcttgaagacagagccggacccctggaactcgccgtcgatgaagagcccgtaggacggctccagggagacgatcgagcgggattccggcgccggtgcgtatgcgaacatggcccctcagtccagggtgaagtagtcaggaccggagtagtgcccggtggccagcttggtgcgctgcatcagcagatcgttgagcagcgaggaggctccgaaccggaaccagtccgggctgagccagtcgtcgccgaccgtctcgttgatcagcaccaggtatttgatcgcgtccttggtgttcttgatcccgccggccggcttcaccccgacctgccgcccgtgccgtgcccggaagtcgcggaccgcctccagcatcaccagggtgatcggcagcgtggcgttgaccgacaccttgccggtggaggtcttgatgaagtcggccccggccagcatcgccagccaggacgcgcggcggacgttgtcgtacgtcgccagctcgccggtctccaggatgaccttgaggtgggcgccgccgcaggcttccttcaccgcgacgatctcgtcgaacacccgggtgtagtcgccggccaggaacgcgccccggctgatcaccatgtcgatctcgtcggccccggccgcgaccgcggcccgggtgtcggcgagtttcacctcgagcggggcctgcccggacgggaacgcggtggccacgctggccaggtggaccccggagccggccagcgcctcggcggccaccgggaccatcgcggggtagacgcagatcgcgccgaccgcggggcaggacgggtcggccgggtcgggccgccgtcccttggcgcacagcgcgcgcaccttgccgggcgtgtcggcgccctcgagggtggtcaggtcgaccatccggatcgccaggtcgatggcccgggccttgctgctcgtcttcaccgatcgggtgccgagcgcggccgccctggcctcgacgcccaccttgtcgaccccggggaggccgtgcaggagggcgcggagatcggacagcccgatggacgctgtcgcagtcatgagactgattctatgcgacccgaggtcagttgatcttgaatgaacggtaggttgatcgccgtggacgtccttgtcgtagatcacccgctggcccagacccggctcaccgcgatgcgccggtccgagaccgagtccggggtcttccgcgcctcgctgcacgagctgaccacgatggtggtctacgaggccgcccgcctcttcgcggtcgagaagttcccgatccagaccccggtcgcggcgaccgagggcacccggctggccaatccgccgctgatcgtcccggtgttgcgggccgggctggggatggccgacgccgcgctggcgctgctgccggagtcgtcgatgggcttcgtcggcctggcgcgcgacgaggagacgcacgagccccgggcgtacatggagtcgctcccggccgatctggccggccagccggtgctggtcctcgacccgatgctggccaccggcggttcgctgctgcactgctgccggctgctggccgaccgcggctgcaccgacatcatcatctgctgcgtgctggccgcgccggagggtgtcgaccgcctggccgcctccgacctgccgctgcgcctggtcaccgcgtcgatcgaccagggtctcaacgagaaggcctacatcgtgcccggtctgggcgacgccggtgaccgtcagttcggcggcatgcgccgcttctgagatcaacggcttgcggcggtacgccgtgggccctcaccccgtcgtgtaaccccacgactgggctttcccgccggcgaacggcatcacgccgtggaacacccgcggctgctcggcgaagaccaggggcaggaagtgccggtcggactcccacatgggtacccggccggccagcacgtcggcgaccgccatccagtgcagcgacccctccgggttgccggtcagcggcgtgccggaccactccgggatccggaacaggaagccgaaccagttctccccgtcgcgcccgaagccgggccaggagacggtgccggccaggtcgacccggtggcactcgaggccggcctcctcggcgatctcgcggcgcattccggcgaccacgtcctcgtccgggtgcaatttgccgcccagaccgttgtaatagccgtaatgcaggtcgtcgggccgggtgtcgcggcggatcatcagaatccgatcaccaccgggagacaggacgtaaccgagcgtagcgaggatggaccgcatgacagggcagcgtaggaccgcccggccggcctcgcgcgcgccgcgctgagaaatcggtagcaagggagaatgctgtaccatgtcgtgcgccgccgacgacgcgcggccgacgccatgccaccatcgaaccaacgggcgtcgttgcggggagtgacgcgtccctccgcaaacctcactcttgttcaggaggatcgcccatgacgggctcccagcctgccattcccgccgctcgccccgtgatcggtgaagaggagatcgaggccgcggtccgagtgatgcgcagcggcatggtgattcagggcccggaggtcgcgggcttcgagcgtgagttcggtgagctggtcgaggggcgtcactgcgtggcggtcaactcggggacgtcggcgctgcagctgtcgctgctggcgctcgacctcaagccgggcgacgaggtgatcgtcccgtcgttctcgttcgccgcgtcggccaacgcggtccggctggccggcgccaccccggtgttcgccgacatcgacccggtgaccttctgcatcgacccggacgcggtggccgcggccatcaccccgcgcaccgtcgcgatcatgccggtgcacctgtacggccaccccgccgcgatggaccggatcatgccgctcgccgaggcgcacggcctgcaggtgatcgaggacgccgcgcaggcccacgccgccggcctgaacggcaccccggccggcgcgttcggcctggccggctgcttcagcttctaccccaccaagaacatgcactcgctcgagggcggcatgatcaccaccgccgacgccgagttcgcgcgcaagctgcgcctgctgcgcaaccagggcatggagcagcggtaccagaacgagatcgtcggcgcgaacatgcggctcaccgacgtggccgcggcgatcggccgggtgcagctgggcaagctgggcggctggacccgcaagcggcaggagaacgcggcgtacctgagcgcgaacctgaccggggtcaccgtgccggccgtcggcgagggcgtcgagcacgtcttccaccagtacacgatccgcttcgccggggaccgggacgccttccaggccgccctcaccgagcggggcatcggcaacgcggtgtactacccgatcccgatccaccgcctccggccgtacctgaccgaggacggccaggtcggcccgtggaagctgccggagacggagaaggcggccgcggaggtcgtctcgctgccggtcttccccagcctcacccaggaggacctggaccggatcgtcgtggccgtgaacgaggccgcggcggtggccgcatgagcgggctgcgcgccgttctgatcgggctgggcgccatggggcgcaaccacgcccgggtgttgtccctgctggacggggtcgacctggtcggcatcctggacccggcgcccggcgcgaccggcccgcacggggttccggtcgtcgccgagctggacgagctgctcgccctgaagccggactacgccgtggtggcctgcccgaccggcctgcacgaggagatcggcctgcggctggccgccgacggcgtgcacgccctgatcgagaagccgctggcgccctcggtcgaggcggccgagcggctggtcgccgcgttcgaggcgaagggcctggtcggcgcggtcggtcacatcgagcggtacaacccggcgctgcagagcctgcggacccgcctggaggccggcgagctgggtgacatctaccagattgtgacccggcggcagggcccgttcccgggccggatcgccgacgtcggcgtggtgatggacctggccacccacgacatcgacctgaccgcgtgggtcaccggcaagccgtacgagcaggtcgccgcgcagaccgtgtcgcgcagcggccgcccgcacgaggacatggtctcggtggtggccggtctgtccggcggcgtggtcgccaaccacctggtgaactggctgagcccgttcaaggagcggtccaccgtgatcaccggcgagcggggcagcttcgtggccgacacgctcaccgccgacctgaccttctacgccaacggcgcgttcggcaccgagtgggaggcgctgcgcgcgttccgcggcgtggccgagggcgacatggtccgctacgcgatcccgaagcgtgagccgctgctcgtcgagcacgagcggttccgggacgcggtggagggcaagcagagcgacatcgtgtcgctgcgccagggcatgcgcaccgtgcaggtggcggcggcggtgctgaagtccgcacgcgagggcatcaccgttcccgtgttgccggcccagggcgagtgatgaccggcaagttctcggagtcgcgcccgccccgggtgctgtacctgtcgttctacttcccgccgagccgggcgagcggcgtgttccgcgcccgcgcgaccgccaatcacctggctcaggcgggctgggacgtcaccgtgctgaccgcgccccgcgagttcttcgagtaccacctcgaaggcgccgcggacccggcgctggaggccacggtcgacccccggatccacgtggaacgacccccgatgaacacctacaactacgagcacgacgtacgccggttcagcacgttccgccggatgttcccgagcgtggcgagccggctgtaccaggagtcgcagaagcggatcttcggcgagcactacatcggctgggtccccggcgtgatgcgcaccgccgtggcccggcaccgcaaggcccgcttcgacctggtgctcgccaccggcaacccgttcgtctcgttcgccgccgcgcactatctgggcaagctgttccggatcccatacgtggtcgacttccgggacgcctggaccttcaaccagttcaccgaggagatccgcttccccgagggcggcctgatgatgaactgggaggagcgggtcctgcgggacgccggcgagatcgtcttcgtgaacgacggcatgcggcggtggtaccaggaccgctacaagttcgcggccgaccggatggaggtcgtcccgaacggctgggagcccgagctgctcggccgcccggactaccggcccagcgacccgaaccggccgctgcacttcagctacctcggcacggtcaccccgtacctgccgctggaggtcctggtcaacggctggaagctggcccgccagcacccgctgctggccgacgcgaacctcgacatccacggccacctcggcttcttcccgcacgaggcggcggccatccggccgcggctgggggagagcccggacaccggtgtggtgtatcgcggcgcgttctccaagaccgaggcggccgaggtctacgcgaagaccgacgggctggtcttctgcgtgcccggggcgaagttcgtgacctcgggcaaggtgttcgagtacatggcgaccggcaagccgatcgtctcggtgcacgagccggacatcgccgccgccgacgtgctcaccgggtacccgctctggttccacggccggaaactggacgcggacaacgtcgcccagtcgttcatcgccgcggcgaaggcggcccgggacctggaccggccgaccttcgagacggccctgcagcacgccgaccggtacacccgggaggccacactgacaccatgggagcaccgcttgcgagcgctggccgagggcggacgacgatgagcgacggtcaccggtcggtcgtctacgtcgcactgggcgagttccggatccgcgccgccgtcacgctgaccgcggagtacgccgcggccggcgcgaaggtgacgctgttcgccgggcggatcccggagtggaaggacgtcaaggcgccggccggcgtcactttgaagcgggtcggtgacaaagcctggccggagatccgcgaggcgctggccggggcggatctgctgatcgccggtgacccgccggcgatgccgatcgtcgacctggcccgcaaggagttcccccggctgaccgtgcggaccgacccacagggcgatccggagcgccggcccgcgccggccgacctggccatcgtcacgccgtggtacccgtcgccgaacgacaccttcgccggttcgttcgtcaaggccgccgccgagacggtgcaggggcaggtgggcagggtgtcgatcctcgccaccgaccactggttctacccgccgtggcggatggtcgggaacatgatcgacatcaccatgcagcgggagctgaagcgcttcggcggggtcaccgtgcaggacaccccggagggcgagctcacccgggtgatcgccccgcagccccgcaagcagccgtacgcgacgtgggcgaacgagcagatccgccggctgagggcggccctgcccaccgggcggatcgaggcgccgctggtgcacgcgcactccgggcacttcggcggcgtgatggcggccgcgctggcccgcccggacgcccggatcatcgtcaccgagcacgccaccttcctgcgccaggtgttcgcccagcccaaggcccgccagcaatacctcgacatgctcgcccgggcggagaccctgctctgcgtcagctcctcgctgcgcgaccaggtcgccgaggagttcccgtactacgcgcacaagctgcgggtggtgccgaacccggtcgacttcgagcacttcgcggtccggcccggcatgcccgaggcgccccggcgctgggtgtacgccggccggatggtggagcacaagggcgtgatgacgctggtcgacggcttcgcgctgatcgccgcggaggacccctcggtcaccctcaccctggtcggcgagggcaagctcgaggacgacctgcgcaagcggatcacagagctgaagctgaccgaccggatccagctgcgcccggccgtgccgccggagcagatggtggccctgctgcacgagcacgacctgctggtgcacgccagccagctggagacgttcgggatgaccatggtcgaggcggtggccaccggcaccccggtgctggtcgccgccagccagggcccggccgagaccctggagggcctggacggcatcgccggccggctcttcccggtcaccaagaagcccgaggtgctcgccgaggcctggcgcgagctgcgcgacgagtggtcgaaactggacctgccccgggcccgtgccgagctgcacgcgcggtacggcttcgaagcggtcggtgaacagctgctggacatctaccgcaacccggccccggccgaggccgcggcgccggtcccggtgccggccgaggacccggccgagcggatcatcgtggtggcggtcctgccgtcccgtccggcccgcacccgggacttcgtcaagcgggcccgggccaaggggtacggcgtcgacctgatcgtgccggacccggccaagtgggcccgcgaggcggaggatccgggcatcgtggtgcacgggatcggcaccgaggaggacccgcccggcgtggtcatccggccggccccgatgaccggctcggccgccgcgctggcgctgacccgcaccgtgcagggcaaggcgcgcacgctgcgcaccaaggtggccgccaaggtgggcaagccgaccgccgcggtcttccgcccgcacaccaagtggctggcgaccaggtcgatcctgccggccatcgatttcaccagggtgaagcgggtggtggtgaacggggtgcagggcgagcggatcggctggcagatcgcccgccgtcacccgggcctggaggtcaccaccgcgttgcggctgccgggcgacaagcacggctgacggcagcggagtctgagcggccacgggcccggctcacgacgtacgaaaaagggatcgccggtcttgaacccgtcaggaccggcgatcccttttcgtcagttgtcgaagaggcggtcgtactgctgctgaacgaccgaccagtcccaggtggagagcgcatgccgggtcgccgcggcgccggtctcctgccagatctcctcggtggcggtgtgcgcgaggatgcgctggacggcctcgtcgacggtctcgaccatccagtcggccgggaagatgctgcgggcgctgtgtgcccggccggcgaagaacggccagtcgcggaccaccgggacggcgccgctggccgcgccctcgatcacgccgaggtggaagctctcccgcaccgaggcgctgaggatcacgccgatcccggtgagcgcgccggccacgtcgtcggtctgcccgagccggcggaccgccccctgcgcctcgaactcggccagctcgcgcacgtactcccggtggtaggcggccgcctgcgggctgggtgagccgtccaggtcggcgccgaccagcaggaggttgtagcggtcgtcgtgcctgcgcagctcccgcaggatcgcgaaggtccagcgcggatccttggcgatccggctctgaccgatctgggccagggtgaaccgggcttccggcgtcttgggccgggcgaaccggtcgagccgggccgcgttggtgagcacgtgcagccgcgggccgcccggctcggtgatccgcggcgccacgtcccgggtgtagtcgagcagcgggtcggagacgaagacgtagtcgtcgatccgggagtagtcgatcaggtgcgggaacatggtgaacgcctcgaacaggtgcagccgcacgatgatccgggtggtgcccgggtcgaccatgctgaccagcgcggcctgcgccaccgaccactcgacgaagacggtgtccgcccactccaggtcgggctggatccactcgcggatcttctccccgtacgccgggtcgccgccgagcagatgtttgatcatgaacgggatccggaccagcttcgccttctcctcgtcggcgagcaggctcagcgtgcggacctcgtgatcgggactcgccgcgtaccggtcgcggatctcgccgaggaagttctcgttgccccgggtgacgaacaggatccggtgcggccggccggccggcggcgggacggccggggtgagccgcccgtgcgccgtggccatcgtgcgcccgaccaggctgaggtgcagcggcgcgaggaactcggccggctgcggcgccatcggcgaggtcatcccgtcgaagtggacggcccggtggaacagcagctgcagcacctggaagacggaccgggtggccgcgtcgaagtccttgcggagcagcagctggtcggcgaccgcgagctcggcggtgacggcctcggtgagaaagtccgggatccggccggcgtccagctcgtccttggcggcggccatcatccactcggcccgcgaccgcggctcgcgcagaagcttggcgacccgcagccgggtcgcggcggcctcggcgggcagtcccagcgtgctcagcttgccggcgatccggcggcccagggcgcgccgctggcggtcgctgagcccgggcgcggtcagcagcgcctgtcccgcctgccggccgcgcggcatgctcagcgccttgccgaccacccggttcccggccttcttggtgaatcgcttggcgctggtgacagccgacttcaggacctcggtcatgcggagtgtgcgcctctgcctcggggacgggagatcggtgagccaatctacgctacccggagcatccggccttactgaccttcagtagcgtggattgctaaggtctgccccctccggcacacgaaaaaagtaggagtctccatgggttcggacgaggcccgccgcatcgtcatgctcgtcgacaacggcgtgaacggcgattcgcgggtgcagaaggaggcacgttccgcggccgaggccggctgggacgtgacgctgctcggccgttcgccggacgacaaggagcacacctggatgctcggcccggcccaggtccgcctggtcccggtgccgttccacctggacaagcggccgcacgagttccgccgccgctgggtgatggcgccgctggcctacccgcagaacggggtcgccgagcagcgcggccagtgggtcaaggcctggcgggcgaacctgacgatggaccggctggtcagcccgggcggtgcgcgggagatctcgcgcaaggtgcagtggcaggcgtcccgggtggtcaacaagtgggtgtcggtccgccagcggcagacgaagaaggcggcgcgcgcgcgcaagacgctggacaccccgagcgacaagctctacacctggttctggagcacggtgcagggcccgcgcgcctggcgccggctggagccgcagctgtgggactgggagctggccttcggcccggtgctcgacagggtcaagccggacctgatccacgccaacgacttccggatgctcggtgtcggcgcccgcgccaagatccgggcgaagacccggggccgggacgtcaagctggtctgggacgcgcacgagttcctgcccggcgtccggccgtggaccaaccacgcccgctggcgcaccgcccagatgctgcacgaggcggagtacgtgccgtacgtggacgccgcgatgaccgtctccgacgacctggccggcatgctgcaggaggcgcaccggctgcccgagcgcccggcggtcgtgctgaacaccccggccgccgagcacgccccggcggacgcggccggcacccccctgcccgacctgcgcgagctgtgcgggatcggcccggacacgccgctgatcgtctacagcggggccgcgtcgatccagcgtggcctggccgtgatggtcgagggcctggcccggcagcccggcgtacacctggccctggtcaccaacaaccacagcagcgggtacatgggcgggctgcgcaagcgggccaccgcgctgggcatctccgaccgggtgcacttcctgccgtacgtaccgcactggcaggtggtgccgttcctggccgcggccaccgtcggcgtgatcccgatcttccacttcccgaaccacgagatcgcgctgatcaccaagttcttcgagtactcgcacgcccggctgccgctggtggtcagcgacgtgcgcacgatggcgtccacggtccgggccaccgggcagggcgaggtgttcacctccaccggcaccccggagacgcaggcgccgccggccgacgtcgacgcctacgtgcaggccgtgcagaaggtgctggacgacccggagcgctaccgggcggcgtacgacaagcccggcctgctcgacggctggacctgggacgcccaggcccgggtgatgaacgacgtgtaccgtcgcctcctgcccgaggcctagctaggaccgctgcgtgcggctgaccaggtcggtgaaggtgtactcgccggtcagccgcagcagcgcgggcagccccggcgactcgccgtccagcgtgatgggcgaatcgtcgaggtacgaccggagtggcgccagccggtccacccgggccgccaccacggcgcagtgcacgccgtgccggtgcgcccgatcgaccggcaccgcctgcagcacctgacagccggccgcgaccagcgggtccagcagcaggtggtagggcagctcggcgatcggccagccgagcagcagcaacagccggccgcccggcggcagcgccggcaccccggggaacgggctggccgggccggcgaacaccacggtcagcgccgcgggcgggtcggcccgctccggcttctcgaacgggaacagcgccgcgaacagctcctcggacccgccggtgtagaagaccgcggggcccccgccggccagcgccggcaactccttgatcagcatcggggtcacccgacccgggtgaacgcgtggaagccgatgacgctggcccggaagtcgtagggttgccatccgtcgtaccgcaagccgagtccctccagaagtggccggtagcgccccggcccacgcagcacctgatagttgccgaaagcctggtcgtggccggcgtcccagtcggagagcaccagccgtccaccgagccggaccagcgacgccaggttgcgcaccgagcgttcccactcgtcctcgtcgaggatgtggaagagcacgtcgatgctgaacaccacgtcgtacagccaggggttgcgccagccggacagcgaggaccggtggaaccggggcccgccgccctccgcctcggcgtgctgcagagcggtgaggctgccgtcgatcgcatccacccggtggccgaaccggaccagctcccgactgaaccagcccttgccgcagccggcgtccagcaggaagagcggggcgaccggcgacgactggagtccgatcaggtccatcagcagggccagccggcgcatgtagaacatccggttggtggcctcgtcgaacgccatgtggccgcccgagcggaggtcgctctcccgctcgtgccgatcatcccagtacgccgatgcctcggagccgctcagaagcgtcatgaccgatcaatgtacgcctcagccgtcactccggcagccttggtcaccgtgggtgaggcggcggtgagtccgcgtgatggccggacgcgggttcgatgcgctaccggcgtggcctacgcttcactacggtcaccgtcaactggacgaccgctcgctgctcacggtgacggtcaacaagttcggggcgagacgaagctgtaccggcgctagccccgccaaggaggaaagctttccgtatgaagatctgtgtcgtcgccctgggcaagatcgggctgccgctcgccgttcagttcgcctccaaggggcacacggtgatcggcgccgacgtctccgagccgaccgtgcgcaaggtgaacgcgggcgaggtcccgttcccgggcgaggccgacctggacgtgaagctgaaggaggcggtcagcgccggcctgctcaccgccaccaccgacaccgcggccgcggtcgccgagtccgaggccgtcgtggtcgtcgtcccgctgttcgtggacgccgacggcaagccggacttcggctggatggagtcggccaccagggacatcgcccgcggcctgcgccccggcaccctggtcagctacgagaccacgctgccggtcggcaccacccgcaaccgctgggcgccgctgctgcaggagggctccggcctggtcgccggcgaggacttccacctggtcttcagcccggagcgggtactcaccggtcgggtcttcgccgacctgcgcaaatacccgaagctggtgggtggcgtgaacgaggcgtccgccgcgcacggcgtcaccttctacgaggcggtgctggacttcgacgagcgcgccgacctgccgcggggcaacggcgtctgggacctgggcaacgccgaggcggcggagctcgcgaagctggccgagaccacctaccgggacgtcaacatcgggctggccaaccagttcgcgcggtacgccgacaccctgggcatcgacgtgaacctggtgatcgacgcctgcaacacgcagccgtacagccacatccaccggccgggcatcgcggtcggcgggcactgcatcccggtctacccgcggctctacctgtggaacgacccgaccgccacggtggtccgggcggcccgtgaggccaacgccgcgatgccgtcgtacgcggtggacctgctcgccgcggccgtcggcgacctggccgggcgcagcgtgctggtgctcggcgcggcgtaccggggtggcgtcaaggagaccgcgttctccggcgtcttcccgaccgtcgaggagctgaagcggcgcggcgccacggcgtacgtgtccgacccgatgtacaccgcggaggaactcgaggcgcacgggctgccggcgtggggcggcgaggcggtggactcggcgatcgtgcaggccgaccacgccgagtaccggaccctcggcccggccgagctgcccggcgtcgaggtggtcgtggacggccggcgggtcaccgacccggagcggctcggctcgatccgccgcgtggtcatcggcggctgacgcggcgcggaggctcccggcgacgggagcctcccggtcccgccttacgggcgtcgctccggatcccggctgacgatctcgcccttctcgtcgacccagccggcgggccgtgccgggttgccgcgcaccaactggtacggcgcgacgtccttggtgacgaccgacccggccgcgatcatcgcgaactcgcccacctcgatgccgcagaccagcgtcgcgttggcgccgatcgacgcgccgcggcggatcagggtcggggtgatcgtccagtccgggttctgcgcgcgcggccgcaggtcgttggtgaagacgacgcaggggccgacgaagacctcgtcctcgatggtgacgccctggtagaccgagacattgttctggatcttgacccggctgccgaccaccgcgttcgcgtccaggtagacgttgcggccgatcaccgtgtcgtcaccgaccgtcgcgctggagcggatgtgggcgatgtgccagaccttggtgccggccccgatccgggcgccgtcctccacgtccgccgaggggtggatgaacggctcgttggtgttggtgttcatgcgaaccagtgtcgcctccccgaattccggctggtgaaccggatggcgaccaacgggctactggcggtcgagcgcacagccgttatgttttctccatgacctccattccgctcgccgaggaactcctacttctcgcgtacgacgatcagacgggtaaagcgaccggctcccggatcgggctcgatctcggcatggccgccgccgtgctgatcgatctcgcgctggcgggccgggtcgcctacgtcgacggctacctgcaggtcaaggacgagacgccgaccggcgacacgatcgccgacgcggtgctgaccaaggtggccggcgacccgccgcacaccccggcccagtggctgcagcgcctgcgccaccggctgcgcacccgggtcctggaggacctgtgcgcccgcggtgtggtcaaggacgtggatgagacccagctcgactacatccacgtgcaccgctacccgaccaccgacccggccttcgaggcggagatccgcggccgtctggccgaggcgctcacctcggacaagacgccgtccgagcgcaccgcggcgctgtgcacgctgctctgtgccgcccgcatggagccggccctgaaactccccgccgaccaggccgagcaggcccaccgccggcttgaggagatctccgcgggcgccggcttcgcggccggcgccaacctggaggactccatcgtgcgccccagcgtcgcgctggtggtcgccaccctgggcaaggcgatctcagccgccctcggcgctcccaaggcggtctgacggcgttcccgggtgtccggtcggacacccgggaggcaacgacctagatgccgaggacggcggcgatctcggcgcgcagcgcgcgcaggccgccggccgcacgttcccgggccgcggccacgtcaccgtcgccgaccggctcgaccacttccaggtacgccttgagtttcggctcggtgccggacggccggatcaccacccggacggcgtcggtgcggaaggtcagcacgtcgttctccggcagcaggtcggtgaccgagccgatcggctcgccgagcagggtggccggcggccgccggcgggcccgggtcatcgccgcgccgatctcggccaggtcgtcgacccgcatcgagagctgatcggtggcgtgcacgccgaactcgacggccaactcgtccagccggtcggccagcgtccggccccgcgccttgagcccggcggccagctcggccgcggtcagcgccgcggtgatcccgtccttgtcccgcaccatggccggggcgacgcagtagccgagcgcctcctcgtagccgaaggccaggtcgtcggccgcccggacgatccacttgaagccggtcagcgtctccgcgtacggcaccccccgggccgcacacaaccggcccagcagcgtcgacgagacgatcgtggtggcgtacacgccgggcgtgccgcgccggatcagatggtcggcgagcagcaccccgagctcgtcgccgcgcagcggccgccacgcgccgtccgggccggggatcgccaccgcgcagcggtccgcgtccgggtcgttggcgatcgccaggtcggccccggtcgccccggccagcgcgaccaggtggtccatcgcgcccggctcctccgggttggggaacgccacggtcgggaactccgggtccggctcggcctggtcggcgaccacggccggggcggcgaacccggcggcgtcgaatgcggcggccagcgtggtgccaccgacgccgtgcagcggggtgtaggcgatcgccagatcccgcggcccgcccgaggtgagcacggcggcggcgttcgcgacgtacgccgcgatgatgtcctcgcccaggaccgtgcccgcgtcgcccagcgggaccgcggcggcgctcgggaccgcccggatggccgcctcgatgccggcgtcggcgggcggcacgatctgcgcaccgtccccgaggtagaccttgtagccgttgtcctgcggcgggttgtggctggcggtgaccatcaccccggccaccgcgcccagcgcccgcaccgcgtaggccagcaccggcgtcggcagcacccggggcatcaggaacgcggcgcgcccggcggcggtcgccacccgggcggtctgctcggcgaacgcgcgagagccgtgccgggcgtcgaagccgatcaccagcggcccctcgccgccctgctgggccagccaggccaccaggccggccgcggcccgggtgaccaccgcgaggttcatcccgttcggtccggcccgcaaccggccgcgcagcccggcggtgccgaaggtgagcggtccggcgaaccggtcgcgcagctccccggcggtggccgggagcgcgtcgatcagcgcgcgcaactcagcccggctcgacggatcgggatcgtccgcgagccaggcctcggcggccgccctcaactcaatatcaacttctggtgccattacggattgatagcacaacccggtcagaggttgagctggaagctgtccgccatggcgtcgaagtacttcctgctgccgtcgaactcggccgccggggtggtcaggaagaaggagtacatcgtgccgttgacctgggtcatccgccagatcccgtgccgcatcgcgtcgccggtgccgcacgtgtattccagctgggcggccgggtgcccggagatctgcaggttggtgtcggtgccgacggccttgaacggcttcgggcagttcgccgacttcttcagcccgttcggggcgatctcggtgacgaagtgctcgggcgtcgacttgcccgactcggccagcacccgcaccttgcgcagcttgtcggccgggtcgacgtagtcgacgtaggtcccgccggcggccctggtccagccggccggcaccttcaccgagatcgccttgctgcccttgtagtcctgggttccggcggccacgccgccacccggcgccgcggcaccggtctgcggtccggcgaccggggtctgcacggccgcaccgccgtccccgccgccggtcaacgagacgatcaggatcagcgccagcaccgcggccgccgcgccaccgccgaccgccagccgcttgttgcgcggccagcccaggaaggtggcccgggccctggcggtcgcgtccttgacggtctgcgtggcgttctgcaccgccatccggcgcttggcggccgggctggtcaccacggtgcccggccgggtggcctggggcagttggtgcgccggcatggtgccggtcgggaaacccgcgtcggccggctccggggcgcgccggcggccgccaccggtgctgttctgctgttccagcttggtcaggtggtcggtgagcgactcgccgggcgcgagcatggcccggccgccgatctgaccgctgggctgcggcgggatctgctgggtggcggccggcggcggcgacaccggccgcggcgagggcaccaccgaatacgggtcggtcatcatgtgcggcgggctcttgctggccagcgggccggccagctgctggcgcagcagggtgcgggcggtctgcacgtccatccgctgggccgggttcttctccagcaggcccatcagcaccggggtgagcgaaccggcccgcatcaccggggccggcgggtcctcgaccaccgcgtgcatggtctcgatcgggtcacccttgtcgaacggcgggcggccctcgatcgccgtgtacagcgtgacgcccagcgagaacaggtcgctgggcggcccgaagtcctggcccatggcccgctccggggagatgaagtgcggcgagccgagcaccatgccgggcgtggtcagctgcacgtcggtgggcatccgggcgacgccgaagtcggtcagcacgcagcggccgtcgttgcagatcagcacgttggccggcttgacgtcgcggtgcagcacgccgtgcgcgtgggccacctcgagcgcgccgagcagcgcgatgccgatcttggcgaccacccggggcgcgaccggcccgtcctcgatcaccatgtcggccaggctgcgcgcgtccagcagctccatcacgatccacggccggccgttctcgtgcaccacgtcgtagacctggaccaccgcggggtgctgcagggcggcggcggcacgggcctcgcgcatggtgcgctcgtacatcgcgtcgcggtcgctgggcgccagccccggcgggaggatgacctccttgatcgccacgtcccggcgcagcagcgtgtccgccgcccgccagaccgtgcccatgccgccgtgacccaccgcggcacgcagcgtgtaccgcccgccgatcagcgtgccgggggccgcgcgcccgttgagggaggccgcgtcaccgctgctccacgtcggaatctgagtcactgaggatgccaccgagggggtctagggggccggggtctgacccagctatcttgcccgctcgccagccgcaacgaaagtcacgcccggactgttcaccaggaaacgaccctgggtagcggccgggtggccgaacgtggacgccaccgggcactgaacgagccttaggatcaccacgtgaacgcagagtcgggtttcaccatcaaaccggtctacgggccggacgacgtgccttcggcggccgggtccgatcagccgggcgagttcccctacacccgcggcgtgtacccgacgatgtacacgaagcgcccgtggaccatgcggcagtacgccggcttcggcaccgccgccgagtccaacgcccggtaccaccagctgctcaaggccggcacgatgggtctgtcggtggccttcgacctgcccacccagatggggtacgactcggacgagccgatcgcgcacggcgaggtcggcaaggtcggggtggccgtcgactcgatcgacgacatgcggcagctgttcgccggcatcccgctcgaccaggtctccacctcgatgacgatcaacgcgcccggttcggtgctgctgctgctctatcagctggtcgccgaggagcagggggtgcccggggcggccctgcagggcaccatccagaacgacatcctcaaggagtacgtggcccgcgggacctacatcttcccgcccaagccgtcgctgcggctggtggccgacacgttcgcctactgccggaccgagatccccaagtggaacaccatctcgatctccggctaccacatggccgaggccggcgccacgcccgtgcaggagatcgccttcacgctggccaacggcatcgagtacgtgcgcgccgcgatcgccgcgggcctggccgtcgacgacttcgcgccgcgcctgagcttcttcttcgtggcccgcaccacgctgctggaggagatcgccaagttccgcgcggcccgccggatgtgggcccggatcatgcgcgacgagttcggcgccaaggacccgaagtcgatgatgctgcgcttccacacccagaccgccggcgtgcagctgaccgcccagcagccggaggtcaacctgatccgggtggcgatccaggcgctcggggcgatcgccggcggcacccagtcgctgcacaccaactcgtacgacgaggcgatcgcgctgcccaccgagaagtccgcccggttggcgctgcgcacccagcaggtgctcgcctacgagagcgggctgaccggcacggtcgacccgttcgccgggtcgtacgcggtggaggcactgaccgaccaggtggagcgggaggccaccgcgctgatcgagcgggtcttcgagtacggctccgcggtcgacgcgatcgagcagggcttccagaagagcgagatcgagcagtcggcctaccggatcgccaacgagatcgacggcggcgagcgggtggtggtcggcgtcaaccggttcaccgcggaggccgaggagaagtacgagccgctgcgcgtcgacccggcgatcgaggcggcccaggcggcccggctggccaccctgcgggccgagcgggacgacccggccgtgcaggcggcgctggcggatctggcgaaggctgccgccgggacggcaaacgtcctaccgtcgatgaaggaagcgttgcgtctgcgcgctactgtcggtgaggtctgccacaccctccgtggggtgtggggcgtatatcgaccggtcgagcgtttctagacgtactcatggtgtgtcacgtcaccctcgtgattcgttacccgttggtgggctggcgggcctactcccgccgcccggcacgtttacgcgaccgttacatagtgtgacgaaaaacggactaagctgtcgcgcgtcgcaaaacccgacgaacttagagagtgatctggaacccgacgtgactactgctctgacggcgcccgacggcgccgatacggcgtggcccgagcctctgcccggcgccgaccccctacccggccagctcgaccgctggctcgccgcccggggagccgagctggtagcgatccgtcggcacatccacgcccacccggaacgatcacactccgagttcgagaccgcggccctgatcgcccgcgaactcaccctggccggcctcagtccgcggctgatgccccgcggcaacggcgtcatctgcgacatcggcgagggcgaccgggtcgtcgccttccgcgccgacctggacgcgctgccgctgcacgacctcaaggacgtgccgtaccgcagcaccgtggagaaggtcgcccacgcctgcggccacgacgtgcacaccaccatcctgctcggcctcgggctggccctggcccagctgcacgagcagggcgagcttccgggccgggtgcggctgctgttccagccggccgaggagcacatcccgtccggcgcccccgaggtgatcgccgccggcggcctcaaggacgtcgccgcgatctacgccctgcactgctacccgcagctgccggccggcctggtcggggtccgctccggcccgttcaccgcggccgccgacacgatcagggtgaaactgtccggccccggcgggcacaccgctcggccgcacctgaccgccgacctggtgcacgcgctcgggcgggtcatcgtcgacgtgccggcgctgctcgaccgccgggtcgacccgcgcgccggcgtctccctggtctgggggtcggtccacgccggccaggcgttcaacgccatccccggcaccggcgaggccagcggcacggtccgcatcctcaaccgggacgcctggcgcgaagcccccgagatgatcaccaaactgatccacgacgtggtcgccgcgaccggcgccggcgtcgaggtcgaataccggcgcggcgtcccgccggtgatcaacgaccggatggcgaccgcggtcatcgcgggcgccgccggggccgcactcggcgccgaccgggtcgtcgaggccgagatcagcatgggcggcgaggacttctcgttctacctggagcacgtcccgggcgcgatgatccggctcgggaccggggtgccggggtcggacgtgcggcacgacctgcaccagggggatttcgacgtggacgaggcgtgcatcgggcacggcatccgggtgatggcgcacaccgcgctcgccgccctctcgaccggcgccttctgacggttcgtccgcttaccgcaagatctagatgtcatgcgccgcggccgatgaccgatcgccgctcatcggtggacccttgttgttgcccggcacctctgagctgggtggcaccgcgggtgggcacggacaccgcaccgctgccacccctgagctgggtggcatccgcgggtgggcgcggacaccgcaccgctgccaccccggaccgccccgggccccgggtccgggcgggtccgggcgggtccgggccggtccgggccggtcgttgccggtgtggcgcgcggctccggcgtgcccgcacccgtcgtgtcgcgggttgcgtggcgacggtgcgggccggctacggggtggggagctggggggtggagcgggcgcggcggtagcggcgggtgaagtaccagagggcccaggccggcacgccgaggaccaggaaccaggggagcagggcgcccaggacggtcagcaggaccgacagcgaggcgaccagggcgtgccagccgttcctgaggccgctgaggaaaccgggggaggcggcggccggggcggccaccgcggcgtccggaccgagcaggacgacggtgaccgtgctcagcgcggtcaggtcggcgaggcggcgcttcttggcctgcagcgaggccaggtcggactcccgggtggcgacctccttctccagcatgaccaggtcgctcagcgacttggcctgggccagcagcttgcggccggagtcgacccgggcctgctggacggcgagtcgggcgtccaggtcgacgacctcctcggtgacgtcctgggtgttgatcgcccggttcttctcgacccccagcccggcgatctgctgcagcgccgcgctgaacttggcggccgggatccgcagggtcagggtggcggtggcggcgccgctgttgccgctctgccggtcgtcgccaccgacgaagccgcccgtcccggccgcgatgccggtggcctgcgcggccgccgcgttcacgtccttgacctgcacggtgatcgacccggtgtagatgatcgaccgctggtccacgctcaggttcggcgactcggccggggtgtccttaccctgtgccgtgctccgctggccggccccgacgctgtcctgcgcggtgccgctgtccgccttcccgcccgcggcggcctcggcgggcgccgcgttgcccccggccggcgcggccgctctgtcgctgctcgccgacgagtccgaggaatcccccgaaccgcaaccggccagcagggcgccgcacagcagcacggcgccggccaaggtgtaaccccgtttccgcatcaccactccgatcgtcgctacgactgaccgctgggacgtacggcgggtcccgtccggttccggcagactgcgagatgaccggtcacgattcagtagcggaggaatcccgtgcgcgtcacgaagctcacccacgcctgtctgcggatcgagggagcgggggtgctggtcgtcgatccgggtgaattctccgagaagtcggcattggacggtgccgacgccgtggtcatcacccacgagcacttcgaccacctggacgtcgccgcgctcaccgaagccgtccggcgccggccggagctccggatcttctcgcacgccgcggtgctcgcccagctcggcgagatcgccgaggcgaccaccgaggtgcggccgggcgacgagttccgggccgccggattcaccctccgggcgtacggcgggcagcacgcggtgatccacccgtacattccgcggatcgccaacctcggctatctgatcgacgacggagccggcagcctctaccacccgggtgactcgttcgtggcgccggacggcgcgccggtcgacaccctctgcgtgccgctgaacgcgccgtggatgaaggtgtccgaggcgatcgagttcgcccgcgcggtcaagccgggccgggccatcgccatccacgacggcctgctcaacgaccgcggcgcggcgatctcggacggccacctggagaggttctccgaaacccgctaccagcacgtcgccccgggtaccacgctcacctgacccgcccgccggtcggccggctggtccgcgtggtggtgccgcgcgggagggggcgacaatgcgagccggcccgtgggtatcggcggtacggaaggggttcggctgaagtgcgaggagccgctggtgtgcctgaggtgatcgacgacgtggtgcggcggctgtacgaggagccgccggaaggtttcgtggcgaccagggcggccgcgatcgaggcggcccgggcggccggcgaccgggatgcggccaagcggctggccgcgctgaagaagccgaccgtggcggcctgggtggtcaatctgctcgcccgccggcggccggatctgatcggtgacctggtggagctgtccgcggcgctgcgggccgcccagcgggaactgcagggtgaccagctgcgggagttgtcccagcagcggcgggcgttcgtgtcggcgctggtcgccgaggcccgcaagctggccgtggcggccggcgccggggccgggaagctgccgctgggcgaggtggagaccacgctgaccgcggcgctgtccgatccggaggtcgccgagcaggtgcgcaccgggcggctgatccggtcggcggcttatgccggcttcggcgaggtgccgcgtccccggctgcggttgatcagcggcggcgaggacgccgacgtgaccgaggacgacgaggacgccgacgcgagcgatccggttgacgagccggccgcgaccgggcgatccagccgtggtgacgcgagcgatccggctgacgggccggccgcgacctggcgatccagccgtggcgacgcgggccggaaaggcgcgggtcccgacgaatcggatccggacgaggcggcgcggcgcgaggcggcccggaacgaggcggcacgcgaggcggaggcgcgggaacgggcggcccgggaacgccggcgccgcgaggaggagcggcggcgccgcgatctggaacgcgacctggccgccgcggaagccgccgagcgccgcgccgacgaacacctcaaccgcgccgaggaagccgaacgagacgcccagcacctggtggacgacctggacgcggaactggccgagctggaacgccgccgcaccgaggcggtcgccgacgtggcccgccgcaaacaggcccgccgcacggccgaacgcgagtccgccgccgcccgtcgtcgcgtcggcgacgttcaggccgccctcgacgacctcccctgaccagccggcgcccaggctggtcacaggatccgccgcgccacgaggagcagcagccgaaggccacgccgcggctcgccccaccacagtcgccatgctgggttcgccggccacggtgcgggccggccggggtccaggggcgcggggcggtccggggtggcagcggtgtcgcgtccgtgcccaccctcggacgtcgcccttgcgggccgggcgctctggacgcgcagcggccagcccggcccgcaagggtcccggcgggagcagcgatcagttatcggccgcagcgcacgacatctgctccatgaatttgatcttgaccttggggcgcggcgcattcagcccggggattgtggatacggtggattttgtaaatcggtcaggcggggcagaatcgggcgggtgacccccgaacaggctgccgccaacgccaaggcgagcctcgccgccatcgtcggcgccttcgccgaatccccgcagaccctgcgccgcgcgcggctgctcgggctctccggctgggcctatcacgtgtcggcccgggccggtgcgctcggtgacgtgcggccggagacggtcgcggccgcggtggcgttcatcgcgccggaggcggtcaccgagggctgggaggcgaccgcgaagagttcgcagccgtccgaggtggccacctggcacctgcgcgagctgtgcacctggggtgcggagcaggtgggcggcttcccgcggctgacccggctgctggagctggccgagcgggtggtgggcgcggtcgacccggccgggctgccgctgttcgcggcctggcgggcgatgccggtgccgagccaggagccgggggcccgcgccgcgatgctgctgcacctgctgcacgagcaccggcagggggtgtacgtgatcgcggtccgcgccgggggcctgaccccgctggaggcgatcatggcggggccggagggggagaccggggcggtggcgctcggctggcaggcgccgtatccgtcggccggcccgctggtgcgccggctgatgtgggccgaggcggtggcgaattcgttggccgggcaggcctacggcaccctggaccggccggagcgggtggagttcgccgggctgctggagtcgctcgggcatcggctggtccgctgaggcaccacggggtgaaaccggttggcagagaaccgcgggccgtggtcggatgccagccatgaccgcgcttccggacggctggaccacacgccggcccaccctcgacgacgtgccgctgattctggagctggtgcacgccagtgacatcgccgcggtcggtgagcccgacttcagcgccgacgaggtgcgcgacgagctgaccgggccgcacaccgacatgagccgcgactcgtggctggccttcgacgacgccgggcggctggccggctgggcctatccgcggaacccgaccggccaggcccgggactttctggaggtctacgtgtggccggggcgcggcgtgccggcccagcgcccgctgctcgacctgatgatggggcggatggccgagcgggccgccgaactgggccacgacccgtacacggtgcgggccggcgcgatcccgaccgagacggagtacatcgaggcgctgaccgcggccggcttcaccttcctcaagcagcacgcgcggatgcggatgtcgctggacgggatcggcgccgaggcgccgcgcccgccggccggggtgacgatccgcccggtgcgccacgacgacgaggccgagctgcgccgcttccacgcggtgatcgaggaggcgttcctcgactccgaccatccggcgatgagcttcgacgactggcggcggcaggccgcgaccggcggcccggtgccgtacgacgagtggttcgtggcggaggcggacggcgagctggccggggtgctgcagtccaccgagccggaggaccgcgacgagggctgggtgcgctatctgggggtgctccggccgtaccgcaagcggggtgtcggtgaggcgctgctgcgccgcgccttcgccgcctacgccgggaaggggcggtccgcggccgggctcggggtggacatggcgaacccgaccgaggccgcacgcctctaccggaaggtcgggatgaccccgctctaccgggcgaatgtgtaccagaccaccgtgccggcggcccgggcctagctttccggggacgccgtcccggtcggacggtgccgcaggtcgctgacgtagtcgtcgggcgcgcccgccttctccgccgcggtggcgatctcggagagataccacgcggtgggcaggccgccctcgtaaccggcgaagacgtacacccaggcgggcacctcaccgtcaagggtcgatacacgcacggtgagtttctggtacgtcccggcgggcaccccctcgacctcgtcgagttgtgccgcatcccacggatgcacgtcgtagagggagacgaagacacggtcgccgggcgactcgacgatcgtcgtcacggcaccctcccagcccatttccccttctccggcaaaggtcaggcgccagccttcgatccaccccacgccgaccatcggcgagtgcggacagtaggccagcatgcgggctgggtccagattcgagccatacgcggcgtagtgacgcacggcgacgacgatagtcgtaacgacggtcggtgagaatatgagaagtgcgtgtcggcacagatgcacttattggaggtcgggtaatcgtgagtcggatcgtgatcatcggtgggggaccgggcggctatgaggcggctctggtcgccgcgcagctcgacgccgatgtgaccctggtcgaggcggacggtcccggtggcgcctgcgtgctgaccgactgtgtcccgtccaagacgttcatcgccagctccgaggtgatgaccggataccgccacaacgaccggttcgggatccgctcccgcggcctggacggggtgagcgtcgacgcgaccgcggtcaacgagcgggtcaagaaactcgccctggcccagtccggcgacatccagaccaagctggtcaaagccggtgtcgacgtggtgcacggccgggcccggctgggcgaggaccggctcggccacacccatcaggtgctgatcaccccgcacgagggcaggccgtacgcggtcgaggcggacaccgtgctgctggccaccggcgccaccccgcgggtgctgccgaccgcccgcccggacggcgagcgcatcctcgactggcggcaggtgtacgacctgaccgagctccccgagcacctcgtggtgatcggttccggtgtcaccggtgccgagttcgccagcgcgtacctggcgatgggcgtgcaggtgacgctcgtctccagccgcgaacgggtgatgccgcacgaggacgcggacgccgcgatggcgatcgagcgggtcttccgcgagcgcgggatgaccattctcagccaggcccggggtgactcggtggtgaacaccggcaccggcgtgcgggtcaccctggccgacggccgggtggtcgacgcctcgcacgcgctgatcgccgtcggtgccatcccgaacacccgggacctcggcctggcggagtacggcgtggcggtcggccagggtggctacgtcaccgtggaccgggtgtcgcggaccaacgtgccgggcatctacgccgccggtgactgcaccggggtgctgccactggccagcgtcgcggcgatgcagggccggatcgcgatctggcacgccatgggggaggcggtcgccccgctgcggctgcgcaccgtctcggcgaacgtgttcaccgacccggagctggccaccgtcggcgtttcgcagaacgaggtggactccgggcgcaccccggcccgccaggtgatgctgccgctgaccggcaacgcccgggccaagatggccgacctgcgggacggtttcgtcaaactgttctgccggccggcgaccggtcagatcgtcggcggggtggtggtcgctccgaaggcgagcgaactgatcctgccgatcaccatggcgatcgagaacaacctgaccgtggaccagctggcccataccatcacgatctatccgtcgctgtcgggttcgatcgcggaagcggctcgtcagctgatgcagcacgagatccagtagccgactcgcggcccccgaaaagggcgaggatccagccggccgtcccgaagatcagggccgcgccggccgcgatcgcgaacagccgccaggccgactgggtgaccgcggtgccgcccagatgcccgaccaggccgccgtaaccggcccagcagagggcggcgccgaggtcgtatgccacgaagagccgcatcgggtagccggtgcggcccgcgtggtagccggacgccatccggccgcccgggacgaaccggcagagcagcaccaccagcggccccggcttgcgcaggccgcgggtgaaccgctcggctgcctgccgggtgcgggagtcggtggtgcgcggggcgaaccgggcgtgcagcgcgctcaggcgatgcccggtggagcggcccagcaggaaggcgatcaggtcgccggtgaacatgccgagcgcgccgatcgcgatgaccacacccaggtgcaggtgaccgtagacggtcagcgcaccggtagtgatcatgatggcctggatcgggacgaccgggatcagtgcatcgaccgccagaaatccgaacagtgcgaggtagaccagtaccggtgaggccaccatcgtcagcagttcggtcattgcaggggccacctcgcggtttcagggctcccggcattgtccgggagcgcacctgagagggcgctgtgttcagcatgcgccacgggaatcgggacagacagtgatgcccgccacggtacgaccgaaaggtcccgtcccgcccccggttttctcggtgtccccgacggcggggcgtaccgttggcggtgcccgcgggctcggatctccccggttcggtgccgcggccgcgggccgccggtaggtcccgtatcggcggcccgtcccagcggccacccggcatcttgtcgctgcctagttatcctgggccggtgaccagaccgagctaccaccacggtgacctccgccgggccctgctgaaggcggccgccgactcgatcaccgaaaccggggtgaccgcgctcagcatgcgggatctggcccgccgggccggggtctcgcacgccgctcccgggcaccacttcgccgaccgggccgggctgctcaccgcgctcgccaccgacggcttcgaacagctcgccaaagccctggccacctcccggctggccagcaacagcctgctcgaactcggggtgacctacctgcggttcgcgctggccaaccgggcgacgttcgaggtgatgttccggaccgacctctaccacgccgacgacccggcgctgctggccgcgcggcgccaggcggccgacgcgctgtacgccggaatgaccgacctgccggacgcgccgctggccggcccggacgtggcgacccacgcccgggccgcccgcgaaggcaccgccgacctggtctccgacgaggtccgcgaagtcggcctggccgcctggtcgatggtgcacggcttcgccaccctgtggctcagcggggccttcccggacagcacccaggaagacccggtggaagcggcccgggtgatcctgggccgcgtccgggcgatgggacggtgagccggtcagccctcgatcgtgcagatcaccgcgccggccgtcaccgtggcgccgacctccagcgacaggccggccaccgtgcccgcccggtgcgcggtcagcggctgctccatcttcatcgcctcgaccaccacgatcacgtcaccctcgttgacctggtcaccgttctgcgcggcgaccttcacgacggtgccctgcatcggggcggtcaggctgtcgccgctcgcgaccgcggtggaggcgccaccgcgaggccgtccggcacgtttctgcggggcggcggcgggtccgggcgtaccggcaagcaggctcttgggcaggcggacctcgacccgccggccgctgacctcgaccacgacggtctcgcggtcggcggcctcgccgccgccgggcgccggcgcgctgaacgccgggacccggttgtcccactcggtctcgatccagcgggtgtgcacggtgaacggctcgctgacgaacgccgcgtcccggaccaccgcccggtggaacggcagcaccgtcgcgatgccctcgatcaccgtctcgtccagcacccgccgcgagcgctccagcgcctgctcacgggtcgcgccgaccacgatgatcttcgcgagcatcgagtcgaagttgccgccgatcacgctgcccgcctcgacacccgcgtcgacccgcacccccggcccggacggccagacgagcgtcgacacggtgcccggcgccggcaggaagttgcggcccgcgtcctcaccgttgatccggaactcgatcgcgtgcccgcgcggcaccggatcctcggtgatcgccagcggctcgccggccgcgatccggaactgctcccggaccaggtcgataccggtcgtctcctcgctgaccggatgctccacctggagccgggtgttgacctccaggaaggagatcgtcccgtcctggcccaccaggtattccacggtgccggcgccgtagtagccggcctcccggcagatcgccttcgcactctcgtggatgctcgcacgctgctcgtcactgaggaacggcgcgggcgcctcctccaccagcttctggtggcggcgctgcagcgaacagtcgcgcgtgccgaccaccacgacattgccgtgcgtgtccgcgatgacctgcgcctcgacgtgccgcggccggtccaggtaacgctcgacgaaacactcgccccgcccgaacgcggcgaccgcctcccgagtcgcgctctcgaacagcgccgggatctcctcgatcgtccgcgccaccttcaggccgcggccaccaccgccgaacgccgccttgatcgccaccggcagcccgtgcgcctcggcgaacgccacgatctccgcggcatcggccaccggctccggcgtacccggcaccagcggcgcccccgcccgctgcgcgatgtgccgcgcggtcaccttgtcgccgaggtcgcggatcgactgcgggctcggcccgatccaggtcaaccccgcggccagcaccgcctcggcgaactccgcattctccgacaagaacccataaccggggtgtacagcgtcggccccggcccgctccgcgatcgcgatcagcttgtcgatccgcaggtacgtgtcggcggcggactcgccgtccagcgcgtacgcctcatcggcgagccgggcatggggggcgtcccgatccccgtcggcgtagacggcgacgctggtcaggccggcgtccttgcaggcccggatgacccggagggcgatctcgccgcggttggcgatcaatatcttccgcacggctagagcctaacgaaagttcagagtcttgctcgcatctcgccacccccttgttggccggcgacgcggcggcacggcatttttggccgcgtcgcggtgttggtggggtgctggtggggtgctttcacctgctggaacagcggcctgcggggtggctggaccgtgcgggggctgtgcggtggctggccgacttgccgctgtccatgcagtggccggggatctcatcgctcggtgggctgcccgacctgccgtccttcaaccgcaggggccccagcggttcacattgggggcgctgacagtccgcaatcctgccgccgcgtcaccgtcggcgtatcagcgccaccgttgccgtgtcatcgccaccgccacacccgccgccgttgccgtgtcatcgccaccgccacccgccgccgttgccgtgtcatcgccaccgccacccgccgccgtgtcaccgccgcccgccgccgtgtcaccgccgctgtcgccgtcgccgtgtcaccgccaccgttaccgccgtcgccgtgtcaccgtcgtcgccgtcgcggccgttttggccgtttcgacgcgcgcggtgccgccgtgtgaaggccgttccgctgtcgcctcgctggcggcgctgctgtgccggtctgccgccgctgccgccgtgctaccgccgccagaggtcgatgatcggcacatccatgtcccggagcagggtgcggagcagcggcagcgacagcccgatcacattcccggggtccccttcgatccgctccacgaatgcgccaccccgcccgtcgagcgtgaacgccccggcaacctgaagcggctccccggatgccacatacgcttcgatctccgagtcggtcacgtccgcgaagtgcaccgcggtcgtccccacggcctccgcctgccgcccgctgaccagcccggtcaggtgatgcccggtgtgcagcaccccggacttcccgcgcatcgccttccaccgctgcactgcctcatgtgcatccgccggcttcccgaagatctccccttcgaacgccagcacagagtcacaccccagcaccagcaccgccggatccgccggcagctccgccgccaccgtccgcgctttcatccgcgccagcgcaaggctcagcgtgtacgcgtcctccgcctcgacgacgctctcatccaccccgctgacaatgatctccgcatcgatccccgccccggtgagcagcgcccgccgagcagggctggccgaggcaagaatcagccggtacgcgttgtcactctgcacaaacggtgagactacaagcctgcgcgccccaaaaccccacgcaagccccatcttcccccaggaatcccccaaccccgccacacccgccgcccaaccccgccgcgccggccgcttgacccctgcgctgcccgcctagccccctgcgcacgccgctcggtccgctgcgccggccgcccaacaccccgcgccggtctcgatgcgttgtagtccgcgccgcgtcccatgctcctgagccacaacgcccgtcactggcaaggccctatctccgccacctcgcagcggtgcggtccttaacctgtgcgtcaccggccgtcctgaccctttgcgtcaacgtcagccagggcccaacaccgcctagtggcgagtccttctccgccgccaagcaacgagcaacccagcaaagactccgcccgccagcacagccgcgactccgccaagaacagcgaccgtccgcccgctgcccggtccatcgccgctcccagccacctggcccgtcccgccaacagcaggcaaactagcccccgcactcaccggcggcacgtccgcggtcagagctttaacaatgttgagcaccccaaacccacactcttcatcccaccccggcggcccaatatcggtagcagtagccgtaagccgatgaataacctcttgcgccgacagctgcggaaacctggcccgcactagtgcagctgctcccgatacgattgccgtcgatgctgacgttcctctggctatacgataagtcgaattcaggccggttgtaacgatttcatctcccggcgcacacagtgacatattcggtcctgtgatcgagaacggtgcgtgatgtccagttcgatcgatagcgccaactgcgagaactccgggtagtgctgcggggtagccgaaccctgcagcactctgggaatttccggaagcagccaccacgaccgtatttgccttcaaggcttggtcaattgaatccttcaatttttgagaagggcttacgccggccgggacgctgattactgaaacgccaagatttaccgaggcggctattccttgcgctagttgggcgttctcggccccgacctcgtatgattttacggggagaatctttgccgatggagctatgccgagtattccccccgctggtccatgtcccctacccactatcaacccggccatttccgttccatgcccatcgcggtcgtattggcccgaattgccgtcactggacgtcagatctataccaggcatcagatttttggatatgtccggatgcggctggatgccggtgtcaggtaacgctatgacgatgccggctccggtagtgattgcgtggacttcctgaattttaaggaagctgaggtgccattctgattcgcgtacgtggtccgcgtggaaaggtggcattctaggaattactgcggcgatggagaataatattctaccgaagtttgaataggcacgcctagtcatttttgagtccgattactgggccggggtcgattaccgccttctctgcaggtagtagtatcggagctactcctttatccgtttcccaaggattttctgggtcccatcgcccgctcgcggactcatcgcgcgacctagatgaccttcttgtaggtgtagatgggctggctatcccaggctgtccgagtatcccgcccgccggattgatgcgttgcgctctattgctgtttgaggcgggacgtgcgcttccaggaattatcggactgccaattacgccgccggctggaagtggttgaaatcctcgggttggggaatgggtgtcttccggcggaagaccaatttttgggcgaacaatctcactgtttgagtttgattcgatgtatctgccggggattccggcagtggaccctgctgcaggcgcacgtgttgcacccataggcggaatcttctccggaactatcacctcgctcgcaggaactgctggttctgactcgccggggcgggaagcggagggggcatggccagaaggtggaggtagtgaattcgatacagggctgcggctgccagattcgccggtgttgtcgccacctggctgagcggactgcagtttatgtcgcgaaaaatcgatagcgggcagggtagctttgtttgaaggttttgatgtcgtattcggtcccggttggccgaacggtcgactatcatcgaaatttttggcgatttcgtacaagggtggggtggtgatgtttagctgggcttggattagttcggtgctcagggtggacatgatggattgcgcctgccgctcaagctccaactgccgagccggtgtcgccgtgttcgggggaaggattatgccccgatacttactcaacggctgggcattctgctgaaccttggcgtcgtaggtcgccagctgctgctggttcgccaggtattcctggtggatggattccagtttttgacgggcgctgaccagcgaggaggtggcggcgcccagggctcggtggttttcgatggtggcttcgtgggtgttggtcaggtgctggatcaggtcgtcgaggcggtccaggtatttggcggcggcggtgctcttgttcgggggccaggcttcggcgaggttgtcccggtaccgtttcacccgggacaggtgatcgatcagcaggtcggcggatttcttccaggtgaccagcaaggttttgtgggtggttccgtcgtgtggggcgagcatcgaccacatttcgggtacggaccgctgggaccagtccgttccgccgccgttgtccgaattggcgaacatcaggtggctcccttggttgacggtggcgacgaccacggtgaggactcggggaaggccggagcagccggcgacggatcaagcggcggcacggccggggcggatgaagaggtgcctgaagaggtggctgccccgtcggcgggcgcagggctggaggcggcggcgggcgcaaggctggtggcggcggcgggcgcagggctggtggcggcggcgggcgcaaggctggaggcggcggcgggcgcagggctggaggcggcggatgacgcagggctgccgacggccccggcaggcggtgaaggatccggcggcgaggccgagaaggcggccgcgtccgtcgagcccgaagatgacgccgccggcagtggcccgccggaggtgggcgggatcaggcccgcaacggacagtgccgcttcgacatctttgaggcgggcgcgggcgaaagcgtccgagccgcggtactgctcgctcacctgctcggcggctttggcgaagccgtgggtgccgttcgcgaagttgtagatgttctgctggcaggtgtcctgcgcggactccagcacggtcgcgaacgcggacagctcgtggaagcgggcgtcggcgggtggcaggcgggtgagcagctggttggacaactgatccgcgtgcggcgcgtaattgttgtcgacctcggccagcaattttctggcgaagtcttccatcgcggtgatgtcagccgatatctgagcgtcagcgcgcaccaggtcgtcgttcggaaccacgcagcgaggctagccgctcaccgggcgctacatcgacccctgtggaaggagcctgtggataactggggcggccgaggccgctcgcgaggagcggcctcggggtagcagaacccgaaagagcgattgccggtacgtcgttgccgccccggacgcgggccaccgctgtcgggaacgccggccaccgctagcggaggccgggtcgcccggaggatcgccaggaccgcgcacccgctgctgggcggcctgatcggatccagtctgacccgggacgggcgggtgttccgtaattgaccgaagtagatcgaactgcgaggatggtgaccagagcagccagctcatgatcgtctaggcttccacgtacgactccgaccagcggttcctcgttcatcggccgagcgtacgacgggtggcccagcttccggtgacacgtgtcccacactcggctgatcaattcgcggccgctcgacagaaccaggtattttctgcgtgatgtcttcttctcccccgctcgttgtcgctgatcggtaccggctggttgcgccgctcggtcagggcgggatgggtcgcgtctggcgggcgaccgatgtcgtcctgcaccgcgaggtggcgatcaaggaactggtgccgccgcccggtctgactcccggcgagcggcaggagatgcgcgaacgctcgctgcgtgaggcgcgggccatcgcccgcctcaacaacatcaacgtggtacgcgttttcgacgtcctgcgcaccgacgccgacccgtggatcgtcatggagtacgtgccgtcccgatcgctgcaggacacgctcgccgcggacgggccgtacaacccggtgcgcaccgccgagatcggcctcggggtgctgaacgcgttgaaggccgcgcaccgcgccggcgtcgtgcaccgggacatcaagccgggcaacgtgctgatcggtggcgacggccgggtggtcctgaccgatttcggtctcgccaccgtcccgggtgacccgaatgtgacgcgcaccggcctggtgctgggttccccggcctacatcgctccggagcgtgcccgcgacggcaccgccggcccggccgccgacctctggtcactcggcgccacgctgtacgccgcggtcgagggccagtcgccgttcgcccgcccgtccgcgatcgccacgctcgccgccctggccaccgagaacgtgccgcaggcccggaacgccggcccgctcaagccggtgctcaacggtctgctgcgcaaggatccggcgcaccggatcgacgccgaggaggcggagcgcctgctggcccgcgccgccggccgcaagtccaagatcagtttcccgatgagcccgacgatgcgccgccccggcgccggccgggaacgcccgtcgctgcccagcggcccgggcggaccaccggtgctgcccggcagcggtttcgtcaccgccaccggctcggcccccgtcgtgcccaccccgcgcccgccggtcaccggccgtcccgaccagccgaaccgcccgcacggcaccccgggcgcccccggctccccgggcatgggcacagcggcatgggcaacagcggcctagctagctagcgccaccccggccggccgttcgccgatcccgccgtccactccgggccgctccccggtcccgccggccaccccgcacggcacccgatgaccggtccgtccgccggccgcggcggtttcacgccgggccgcgccacggtcggccgcgccacccccggccagaagcccctcgacgcgacaaaggtcgacggccccgcgatcaccgacgaccagcccggcacccgcggcccgtccaacctcgccggcccgtccggccccgctgccacccgcggcccgtccgacccggccgggtccgacccggctggctccggcggtcgccgcggcctggctggttccagcggtcggccggacctggccggctccggcggtcggtccgaccaggcgggcaccggtcgttcggccgacctcgccggcggtcgtccgggctctccggcccgaccggtcccgtccgagctgccggccacccaggtcaacacggccagggtcggtttcaccgccgccgacgtggccgccaaccgccgcaagaaggcggctccggaacatgaggcttcgctcgccgccgccaccggctcctaccccgtcgtttccggcgccgagcaggaccccgacaacagctcgcggcagcaggacagcggtgcggcggcggcaacgcccggcgacgcgtccaccgtgccacccgcgaaggcgtccggctcgaaggccgcgacgagggatgcgcggcctggccagagttccggcacgccgaccgcgggcacgccgaccgcgggtacgccgaccgcgggcacgtcggacgcccggaccgccggaacatccgggccgaacaccgtgaacgcgccgggtaccgacacctcggaccctgtggggcgggctgggcgcgcggtttccgccggtgcggcgactgccgccgcgggccggtcgctgtccgattctgcccaggcggaatcggacaagatccgcgcgacgccgcagtctgacgagatcggcgcgcgcccggccgctgtcaccgagaaccggattgcgccgtacgcggcggagctgccggactccgagcccggccgcaccgcctccacggaatcggagcgagtgtcggctcccgccgcgaacatccagccgtccgtcagcagcggcgcccgtgacgccgatggcaccggcgacgccgaaccggccgactcgtcggtgtccacaggcgctgaccggaaagcggcctccgacagccggaagccggattccggcgatcagcagcccgtcgtcgacagccggaagccggagtccgccggcgctcagcccgttgccggcagccgcacgccgcagtccaacggccagcagtccattgccggcagtcgaaagccgggttcagacagccggacgcctctcgaccggcagagcctcggctccgattccggtggtcagcgctccgggtccgaggctcccgagtccgggttcacatccgaagccgatggtcagcggtccgggtccgggtccgggtccgggtccgggtccgacgatcatggatcaggggctggcggccagggttccgggtccggcggtcggacgtccaagtccagcggccagggctccaagccgggcggcccgggctccgagccgggcgaccgggcctctgggtccgacgaccggcggcagacggccagtgaccggaaatccgggtcaggcagtgagaagcgtgggtccggcagcctgaagcccggctctgccaaggaaagctcccgccaggatggcgggctcgatacggccggtgctacagccgctggagtggtcgcggacgcatcgagggcctccgcctcaacggcgtccgccccgacgacttccgccacgaaggcgacgtcgggcggtcccggcgccgacgccgagaccgccgatggatcggttgccgcggcggactctgaggcggaccgggcggccacgagcaaggccggagaagtggcggccacgagcaaggccggagaagtggcggcctccagcggggcgacggcaacgaccggtgcgaaagccgcaggcgaagcggccacggatacggtccccgccgaggcgaagggccgatcgcaggacaccgctgagtcgaatgccaaggcacagcgcgccaatgattcggagcgcgcggctgggccccgcctcggggtcgagtcggggccagggcctgcgggcaagcggaacgctgaatccggcggagccgcggaacgggcggctacgccgctcaccccggggcagcggcccggcggcacgccggagcaggatcaggaccggacttcggttgtcgacttcacggcgatcgtgccgcagtcgccggcggtgtccgcggccgagcatgacggtgcgacgcgggtggtgaaccagcttcccgggttccggccgtccagccgtcccgcgtggacgccgatctcgacccgtccggtggtccggcgggtcaacgggatcacgatcttcggcacgacgctgacccggcggcaggcgacgatcgcggcggccatcgtgctgaccttcgtcctgctgatcgggatcatcctggtgcaggcgttcggttcggacgacgacaagaaggcgaccagcaccaagccgggcgcggtcggcaccggcaaggtggcgccgccgggcaagcccgcggccagcaccggtgcggacaagccggccagcatgccgccgtcggctgctccgtcgtcggccgcgccgtcgggcggtgtcccggccggatggagcaaagcggacttctccggtttctccttggcgcttccgcagggctaccagatcgggcggagcgacgccggccagaccgagatcaaactggacgggaatcggctgctgatcgttctccgcggcaccgacacgcaggatccggcggcgcagttgaacagtgtcagccggtccgggttccaacgggtcgggtcgatcaggccgctgcagtatcagggccggcctgccgctgatctcgagtactactactacaccagccacggcaacaaacagcacgtcgtgcgccgggccttctcggtgggtggcgcctcgtaccagatctgctggtacacctcacccgatgactgggactcggccgccgccgagcgcgaggccgtgttcgccggtttccaggcgggctgagcgcccggccgggaccaccggtcttccgtgggcggaccggccggtgacgtacataaatgtgaatttcatgcgtgatgtcgaggcagcgcgggtagttgtcgagaatcacgaatggaggtgcgccatgaactgccgacgacacggcagtaagcccacgctggcgctgtggatgctggtcgcgtgcgcggacatcgcgatcgtcgcggccgctgccggcccgatcaccgtcctgctcgtcctggccggtctgctggtcgctgccggcggcgtctacgcggcgcgaagtctcggcaaccgggccccggccgactccgcggcccgccgccgcgcctgaccgctcgatcgggcgacgcgcggagaagcttttcggcaggctgatcggctacagtgcccggcgtgttgtcgatcgagggtttcagcggcctgcacgacgtgaacggcctcagcgatctgtgggaccggttgatgagcgcccagcccgaccccccgggcatcctggtcctggtcaccgcactgatcgggttcgccgcggtcttccggccggcctggcgggtcacccggaacgcggtgacgatcgcccacgagggcgggcacgccctgttcgccctgctcaccggccgccggctgcgcggcatccggctggagttcgacacgtccggcctgaccctgtcgtccggccgcccgaccggtgtcggcatgatcctcaccctggtcggcggctacatcgccccgtcgctggtgggtctcggcggcgcctggctgctgaacgcgaaccgcatcacgctgctgctctggctgaccgtgctcctgctgctggtcatgctgatcaacgtccggaacctgttcggcgtgttgtcgctgctggtcaccggcgcgatcgtgttcgccgtgtcgtggtacgcggcgccggacacccaggccgcgttcgcctggaccggggtgtggttcctgctgttcgccggcgtccgcccggtcttcgagctgcagagtctgcgccgccgcgggcggatgcgggactcggacccggaccagctggcccgcctcacccacctgccggccctgttctgggtgggcttcttcctggtggtgaacgtggcggtgctggtcaccggtgcgttcatgctggccggtcagtacctcccggccagcacgtaacgacgtaccgcggcaatcaggtcctacagcgggatgttgccgtgcttcttcggcggcagcgtctcccgcttggtgcgcagcatccgcaacgcccgggtcacctgcgcgcgcgtctcggagggccggatcaccgcgtcgacgtagccgcgctcggcggcgatgtacgggtttgccagcgtgtcctcgtattcctggacgagctcggcgcgccgggcggccgggtcgtcggcggccgcgagatcgccgcggtacaggatgttcaccgcgccctgcgcgcccatcaccgcgatctgcgcggtcggccaggcgaagttcatgtcggcgccgatgtgcttggagcccatcacgtcgtacgccccgccgtaggccttgcgcgtgatcacggtgaccttcgggacggtggcctcggcgtacgcgtagatcagcttggcgccgcgccggatgatgccgtcccattcctggccggtgccgggcaggaagccgggcacgtcgacgaaggtcagcaccgggatgttgaacgcgtcacaggtacgcacgaaccgggcggccttctcactggccgcgatgtcgagggtgccggcgaagtgggtgggctggttggcgaccacaccgaccgggcggccctcgatccggccgaagccgaccacgatgttctgcgcgtacagcggctgcacctcgaggaagtcctcgacgaccgtctccaccacggtcttgatgtcgtacggctggttgggggagtccgggaccagcgtgtccagggccaggtcggcgtcggcggcggacaggtcggccgcctcctcgtagacgaccggctcgtccaggttgttgctgggcaggtaggacagcagcgcccggacgtagtcgatcgcgtcctcctcgtcggaggccaggtagtgggcgttgccgctgcgggtgttgtgggtacgcgcgccgcccagctcctccatgccgacctcctcgccggtgaccgtcttgatcacgtcggggccggtgatgaacatgtgcgaggtctggtcgaccatcacggtgaagtcggtgatcgcgggggagtacaccgcgccgcccgcgcacgggcccatgatcagggagatctgcgggatgacgccgctggcccggacgttgcggaagaagatgtcggcgtacaggccgagggcgacgacgccctcctggatccgggcgccaccggagtcgttgatcccgatgatcgggcagccgatcttcatggcgaggtcgaggaccttgacgatcttctcgccgaagacctcaccgagcgaaccgccgaagaccgtgaagtcctgcgagaacacacagacctggcggccgtcgacggtgccgtggccggtcaccacaccgtccccgtacggccggttgcggtccaggccgaaggcggtggaccggtgccgggccagctcgtcgagctcgacgaaggaatccttgtcgagcagcagctcgatccgctcgcgggcggtcttcttgccgcgggcgtgctgtttctcgacggcgcgcgcggatcccgcgtgcaccgcctcgtccgagcggttcgcgaggtcggcgagtttgccggcggtcgtgtggatgtcgggctgcgttgtcacggtggtctccacgctttgaggcggccttgcactcacgatgatcgtagctgtgagccgggttcgcgttggagccgtcggaacgggtccgtttcatacctgttgtcccattcgttacgcctcacgtgacgaactggatgaccgcggccgggctcgctttcatcgcggggggcctcgccacactgatcagtttccgcgcggtgctgttcggcggcgagaccgagccggagcggccccggcagcgcggccgtcggcaacctagctagctagcggcgatccaccggccggtcgtccggcccggcgccgccggctggccgccgcgttcgccgggcgggacgacgtgcatgccgacgagggtccggccttcccggatctggctccgccggacctggccttcccggacctggctccgccggacccggccttcctgcgtcacgccgacgacctcggtgcggggcccttcggtgacgagagcggcgcctaccccgcgatgccgtggggcgacgaggagatggccggcgacgaaccggccggcgaggcatcccgctacatcgacaacaccgcgtggcggaccgatcccgcggcggcggatccgccgcaggccggggacgatgtgcggtacgaccggagctacgccccgccgcgccaggcgatcgaccgttccgaccgggcctacggcgaccggatcgacggctgggtccgcccccgctaccgcgacctggacgatcgcccgccggccggggactactggacgccggtgccggacgatcgctacgccgacccggagccgtccgcccgtgcctacggctggccggtaccggtcgagcggctcccgtcggttcccgactacgagccggcgaccggtttcgatctgacgccgatgcaggcggccgagccgaccacgctggtgccgacctggccgccgccgtcaccggaccaccggatccgcctgccgcgctcctggtccgaccgcgaccggaacctccgcgacgcggccgaccgcgaccgggacgcccgggatgcggccggccgggatctgaacgcccgcgacgcggccgaccgcgaccgggacccccgggatgcggccggccgggatctgaacgcccgcggtgcggccgagcgcgactgggacgcccgggatgctgccgagcgcggctgggaggctcgggatgcggccgagcgcggctgggacgctcgggatgcggccgagcgcggctgggacgcccgggatgcggccgagcgcgactggaacgcccgggacgcggccgagcgcgactcctgggcaccctgggagcagcccagcgtgtcgcgtgcccggatcgtctcccgggacgggcggagtggtccgcgggccgtcccggcggtgaaccgggacgaaccctcctggaacgatccgtcgcggcgcagccgccgctccgccggtgacccccggccgcggccccgcccgcgtcccgccgcggtcgaccaggactatgtgagccggcactcggcaggcccgcaccgctgatcgccggcgggcggcataggctcccgggatggcgtacaccgacctcgaccgcccgcccctctcggagcgcgcgctgacccgcgccctggtgcagcccggagcgctctggtcgcggatcgaggtgcgcccggagaccggatcgaccaacgcggacgccaccgaggcggcccgggccggcgccgcggagggcctggtcgtggtcgccgagcggcaggtcgccggccggggccggcgggaccggcagtggctcagcccggcccgggccggcctgaccctcagtgtcctgctgcgcccgggtaccgctgatcaggagcgtggctggccggccgccggcccgggtgcgttcggctggctgccgctgctggccggggtggcgctggccgatgcggtgtcccgggtgaccaccgtcgacgccaccctgaagtggccgaacgacctgctggccggggaccgcaagtgcgccggcatcctggccgagatggccggtgacgcgatcgtggtcggcatcggactcaacgtcagcacccgggccgaggagctgcccgcgacgaccggggtgccggccacctcgctgcggctggccggcgcggagaacccggaccgggaccccctgctgcgggcgctgctgcgcagtgtcgagcggtggtatgccgggtggcgtgaggcgggtggcgacgcggagatgtgcggcctgctcggggagtaccggcgccgctgcgcgacgatcggccgggacgtgcgggtgctgctgcccggcggtggggagctgctcggtgaggcgaccaccgtggaccgggacggccagttggtgatccgatcggtggacggtgccgagcatcgcgtctcggcgggggatgtgctgcacgtacgctgaccggcgtggcgttcccggcggaagttctctccgagcaggaggaggtcgtgctccacctgcgtccccatgggaagtcggtggtcggcccggccctggtactggtgctgaccgtggccggcaccgtgatggccggggtgctgctgcccggcaaccagggtggccggatcggcttcggtctggtcgccgcgatcatgatctaccacgcggcgcggtacgggatcgcgccgctggcccggtggcggtgcacgcactacgtgctgaccaacgagcgactgctgctgcagcagggcgtcttcgcccgggagcggcgggatctgccgctgaaccgggtgaacgaccatgcgctgcgccagtcgctgctggaccggatcttcggcaccggcacgctggtgatcgactcgatcggcgagcagagcgcgcggctgtccggcgtgccgcaggcccagcgggtgcagacccggctctacgaactgatcgagctgagcccggcggacgacgaggacgccgaggaggagctcagctcttcagcgtggcgtccagctccgccgcgctccccgggacgtcgatcgcgctgagctcggccaggccggcggtcgcgtccatcccggtgatcgcgccctcgtggccgtcgaccggcggcttgaggaagacgaaggtccggtacgcccagaagcggaagaccgtggcgatcccgatgccgatcatggtgaccagcatgaagtggatcttgtcgtccttctcgttcaggtggaagccgtacttgccgatcgccaccaggccggactggatcaccatgcccaccaggttgaagccgaagaacagcaggtactcccggcgcagcgcggtgcgcgtgtggtgccggtaggtccagaaccggttcgccaggtaggccagcgtggtggtgatcagcgtggcgatgacgttcgccttgaccgcgccgatcggcagggccacccagcagatcgccatgtacagcagcgtgtttccggctccgatgacaccgaaggcgacggcttccggggcgagacggcgcaggcgatccgtcagcgttgggcctgagggcattgggccaccttacgagggccggggcgagaacgccgaatcacgggagggtgggtgacgacgttgtcacaccggtggtccgtgtctcggcccggaagacgaaccggcgataggaccagaaccggaagatcgtaccgatggcggtgccgatcagcagtcccgcgacgttgtcggcggccttgccgcggaacaccggccagtagtgccccagaccgtagtggctgatcgccaggcaggccagcgagatgcccaggccgaccgcgttgagcacgaagaacgtcgtgtactgccgggccaggttggggtgcgcgccgtcgcgccacgtccagtaccggttgccgaggaaggccagggtggtcgccacgatggtggacccggtcttcgcggtcagcggctcgacgccactgttgcgcagcatgttgaacagcagcaggtcgacgccgaacgcgatgccgccgaccgtgccgaacctgcccgcctcccgcgccagcttccgcaaccgcacccgttcgagggtaccggcgcggcacctgcgccgccgatctcgttgcacgatctcaaccggcggtgccggcatggtcacgttgccggtacggggagtggcggaagccgtcgatctcccggatctcggcgagccggccccggcagtccgcgcaccgtccgaggtgggtccgcatccggtgcgcgtcgcgtggggcgagccggccgcgcacctgcgggccgagccgctcgccggcccaccggcactccgggtgctcggccgcggtcacgtgctgctggagatagaggctgcgcagtccctcgcgggcgcggtgggccaggacggcgaccgcgttcggcgtcagacccatccgcggggccagctcggccggggtgctgccctccacctcggtctgccagagcacgtcgcgccaccggggtggcagctggcggaacgcggccgcggcgaaactgcgttccagccggtcgagcgccgggtcggtgaacggctggccctcgtcgtaccggctcaggtcgtcggtgaactccagccgccggtccgagcgggcccgctggtagcagacgtgccgcatggtggtgtgcaggtacgcccggaaggcgaccagcggcccgcgaccggcccgcagtgaggcgaacaccttggcgaacgtctcggcgaccaggtcgtcggcgtcggccggatcgcgggcgaggccgaacgcgaacaaccgcgccgccgcccggtgccgctcatagagcgtcccgtaggcggcggtgtcgccggcccggacggcggcgagcagatccgtgtccgagtccacgtcgttgcccggggtcgtcattccgcctcctgtggccggaactgcgaggaaagcccgattaggtgaaagtgtacggcgataagtcccttttgcgaaagttgtcgtcaacggcggtgtcgccgcccggtgtgcgcgctcgtgcacgcggcggcgaagaatcaatcgtcatcgcgcacggcagccaaagattgtgcggttgtccacaggttcagccgatgaactgcatgggtatggggcttaacctgatgtgactcccatgacaacagccggtttttccggacggtccgtcattggtcagtgccgaccgaaggagcttcaccttgtctcacccccacacctcgcacccccgcctgctggcgtggatcgacgaggtcgccgccctgacaacgcccgaccggatcgtctggtgcgacggttcggacgccgagtggacccggttgaccgacgagctggtcgagtccggcgcgctggtccgtctcgacccggagaagaagccgaactcgttctgggcgcgtaccgacccgtccgacgtggcgcgggtcgaggaacgcaccttcatctgctcggccgacgaggccgacgccgggcccaccaacaactggatggcgccggccgagatgaagaccctgatgacggagctgtaccggggctcgatgaagggccggacgatgtacgtcgtcccgttctgcatgggcccgctggacgccgagaacccgatgttcggcgtcgagctcaccgacagcccgtacgtggtgtcgagcatgcgcatcatgacccggatgggggccgaggtcctgagcgcgatgggcgacgacgcggacttcgtaccgtgcctgcactcgatcggcgcgccgctcgaaccgggccaggacgacgtcgcgtggccatgcaacgagacgaagtacatctcgcacttcccggagacccgggagatctggtcgttcggctccggctacggcggcaactcgctgctcggcaagaagtgctacgcgctgcggatcgccagcgtggccgcccgggacgagggctggctcgccgagcacatgctgatcatgaagctgacctcgccggagggcgtggtccggtacatcgccggcgcgttcccgtcggcctgtggcaagaccaacctggccatgctcgagccgaccctgccgggctggaaggtggagacggtcggcgacgacatcgcctggatgcgcttcggcgaggacggccggctctgggcgaccaacccggagttcgggctgttcggcgtcgcgcccggcaccgacttccacaccaacccgaacgccatgcgcaccctggccaagggcaactcggtcttcaccaacgtggcgctgaccgacgacggcgacatctggtgggagggcatgggcgagccgcccgcgcacctgaccgactggaagggccaggactggacgccggagtcggaggcgccgtcgagccacccgaacagccgcttctgcaccccgatcgagcagtgcccgatcctcgccgacgaataccacgacccgcgcggcgtgccgatcgacgcgatcctgttcggcggccgccgcaagaccaccgtcccgctggtcaccgaggcacgcgactgggtgcacggggtctacctgggtgccaccctgtccagcgagaccaccgcggccgcggtcggccaggtcggcgtggtccgccgcgacccgatggcgatgctgccgttcatcggctaccacgccggcgactacttccagcactggatcgacatggccaagggcgcctccggcgacgcgtccaagctgcccaaggtcttctacgtgaactggttccggcgcgacgccgacggcggcttcctctggcccggattcggcgagaacagccgggtgctcaagtgggtgatggagcgcctggacggcaaggcagacgcggtggagacgccgatcgggcacgtcgccaccccgcagtcactcgacctgaccgggctggacatcgaccaggccgccctggaggcggtgctgcgcgtcgaccgcgacgagtggctggccgagctgccccaggtcaccgagtggttcgagaagttcggcgacaagctgcccgccgtgctctgggcggagctggacgcgctgcgcgcgcggctggccgacgcctgacccacggactcggcccgcgtccgccctcaacggcgagggtgggcgcggccggccgtttataacgctttcggcatcgtcgtcacccggacggccggcccggcggtggcacgatcaggtttattcctggtgcggacgggtccaccgggcgccgccaccggtggagtgccggacgcgggtggctacccttgcccgtgatgagtgtgcgctccctggtctactccctctatgagcgccggctcgccggaaagttggtcggcaagccggtgccccgccacgtcggcgtcatgtgcgacggcaaccgccgctgggcccgcgagatgggtttcgtcgacccgaacgacggccaccgggtcggcgccgtccgggtcaaggatctgctcacctggtgtgacctggccggcatcgagcacgtcacgctctatctgctggccaccgacaacctgcagcgcccggccgccgagctggatccgctcgtcaagatcatcgaggatctggcgaccgagctggccgaggagggcaacccctggcggctgcggatggtcggcgcgctcgacatcctgccggccgccaccgccgccaccctcaaggccgcccaggagaagacgcaggaccgctccggcggcgtcgaggtcaacatggcggtcggctacggcgggcggcgcgagatcaccgacgcggtgcgctccctgctgcagcagcacgcggcctccggcggcaccctggaggagctggccgagatcctcgacgtcgagcacatcgccgagcacctctacacccgcggccagcccgaccccgacctggtcatccgcaccagcggggagcagcggctgtccggcttcctgctctggcagtcggcgcactcggagttctacttccacgacgccaactggcccgacttccggcgcatcgacttcctgcgggccctgcgctcctacggcagccggcagcgtcgttacggcgcctagaccgccgcgccccggacccggccgcgcctcgcgcatgcggcgggtccggacatcaggacgattgccacggtacgacgatcacttcgtaccgtggcgatcgtgtctcagaaggtctgcagccccgcgtcgaggaaccgggcgacggcctcgggggaggcgagcgtgaggtcggcggcgttggacacctcggcgccggtctcgtcgttggccaccgcgatcgccatgccgaagaagccggggtcgaccgcctcccgggcgcgcagcgcgtcgaacgccttgacgtcggacatgtcatccccgaaataccacgcgcagccggcgtcgcggaccgcctcggtgatcaccatgcccttgtcctggtcgaccgggggcttcagctcgaccaccatgcggccccgctggatcagcagaccgtgctgctcggcctgctccagcgcccatttctcgacctgcgcggcgcgggccggatccttgcggtagtgcagggcgacggcgagccgcttgtattccacctcgaccggccgctccagcgccccacgggcggcggcggccagctccttcatcggctcctcgtagtcgagggcggcgggcttggtgaccacctggccctcgtgccacacctcgaggccgtagaggccgaacaggtcgacgtgggccagcgacgcgaaatgcgtgcgcaggaaggtgaccggacgggcggagacgatcgccacccgggcgacccgcgcggccaaccggtcgagaacctcggggatcccggcgaccggacgggactcctccggctgctcggtgatcggtgagaggaccccgtcgaagtcgaagaagaacgtggtccgggacgcgtgccgggcggtgcgcgcccaggcgtcgtcagcgctcgcgggatgggtcggacgctcggtctctgccacgtcgccagactacccgggcaggggggtcttttaagcccggcggaattcacgtggggcgagcgtcacccgcgggtgcccgattttgcgcactaccgcgggagcctgttgaccgctagcgtttgtgtcatggcacggggtcatcccgagccagccggccggcccggacctgcgacaacttgcgccacagggcccgcatccctgccctgtgcatgtgccggcggccggaggtggcggaccgcgggtggcgggttgcacgcccgctggagcaggcctgtgacatctcgccgtaccgatgccggtgtcgcctcttcatccgacccggccgacaaggtgaccaagacccgtgccacccccgcccgccgtaaggtgcgggaccggcacgccgacgccgagcccgcccccgctggcaaggtcttcgtcctggacacctcggtcctgctgtccgacccggcggcgttccgccggttcaccgatcacgaggtggtcgtccccctcgtggtcatctccgagttggagggcaagcgccaccatcccgagctcggctggttcgcccggcagtccctgcggatgctggacgagctgcggatcaagttcggtcggctggatcagccggtgctctgcaacgacgagggcggcacgctgcgtgtcgagctcaaccacgccgaccagagcgcgctgccgcagggattccgcaacgactcgaacgacacccggatcctctcggtggcgctcgggctggccgcggagggccgcgacgtcacgctggtcagcaaggacatgccgctgcgggtgaaggccgcctcggtcggcctcaccgccgacgagtaccggcacggccaggccagcgaccccacctggaccggcatggccgacctggagctcggcgaggatcaggtcaaggcgctgtacgcgggcgacgagctggaggtcgaggaggcggacaatctgccctgccacaccggcctggtgatccactcgtcgcgcggatcggcgctgggccgggtcaccccggacaagacggtgaaactggtccgcggcgaccgggacgccttcgggctgcgcggccgctccgccgagcagcggatcgccctggacatcctgctcgacgagtcgatcgggatcgtgtcgctgggcggcaaggccggcaccggcaagtccgcgctggcactctgcgccggcctggaggcgaccatggagcgcaaccgccacaagaaggtggtggtgttccgcccgctgtacgcggtcggtggccaggagctcggctacctgcccggctccgagtcggagaagatgtcgccctgggcgcaggcggtcttcgacacgctcggcgccgtggtgcacgccaacgtggtcgaggaggtgctggcccgcggcatgctggaggtcttgccgctgacccacatccgcggccgcagcctgcacgacgcgttcgtgatcgtcgacgaggcgcagtcgctggaacgcaacgtgctgctgaccgtgctatcccggatcggccagaactcccgggtgatcctgacccacgacgtcgcccagcgggacaacctgcgggtcggccggcacgacggcgtgacggcggtgatcgaggcgctgaaggggcatccgatcttcgcccacgtcaccctcacccgttcggagcggtccccgatcgccgaagtggtcaccgacctgttggaggacatcccgttgtaagccttctcggggaatgccgacgcggatcctttgtcccgattgtagggaaaattggagtgactaaagtcacagatccgcgtcggcatttcacaacgccctcacgctgcgccatggtgtctggcgagcaccatcgactcgtaacgacgtcgaagatcgacctcgcgggtgcgaggtggcagcccagcggggttgcgggtgctcgcggcatgacgctctgtcactgacggggccgtgccgcgtcattgcccccgacgaagggaatcttcgtgaatcggctctggagccggctcggagttcgtgcgctgtctgtcggtctgctcgccgcgggtctcggcggcggtctctacctcggacacggccaggacgaccagcagcagagcagccaggcgactctcgtggcccaggcgaacgcggaggagatcgcgctgctcaagcagcgtgaggcggaccacgccgcggcccgcgcctaccgccggacggccgaggacgccgccgccgagaaggcggccggcgaggcccggcaggccgcggcgaacgcgcgcaagctggaggtcaaggtgatcgccgacgcggcggccaccaagaaggccgccgacgccaagaaggcagcctccgggggcgcggtgccctacgccggccacatcccgtcctcgtgcaacgacttctccggcagccgccagatcggctgcgcgctgatgctggacgccggcttcaagatcgaccagttcccgtgtctcgacaagctctggaagcgcgagagcgggtggaactacagcgccctcaacaaaagctcgcaggcgtacggcattccgcaggcgctgcccggcaggaagatggccaagttcggcgccgactgggagtccaacccggccacgcagatcaagtggggcctcgactacatcgagggccgttactcctcgccctgcggcgcgtggggccactcgcaggaagtcggctggtactgaaccgtcacatgacggggccgcgcggctagccgtacggccccgttctgctgtgatcaaatgtccgtatggtccgaaatgtcgcttcgttcctggcgatcgtggtcacggtgctcgccgccggtgacgtgcccgcccaggccggcgccggcggacggcccatcctcgaagtggtcggcggcaacgtggccaagaccggcgagttcccgtgggtggtccgactgtcgatgggctgcggcggggcactgaccgcaccccgggtggtactcaccgccgggcactgcgtcggcccgaccggacccgacaagcggatcgtggtcaccgccggggtggccgacctcaaggcccgcaacgcggtcgtcgcccactccgtcgaagtggtccgggcccccgccttcaccaccgagacccgcggcaacgactgggccgtggtcaaactcgaccgggtgctcgacctgcccgccctgcccctggtgccggacgccaccggggacaccggcgacgtcaccgtgatggggtggggacagaccagggagggctccctgcggcaggaacgccggctgcactacgcgacggtgccgaccatcccggacgcgacctgcgccaaggcgtacgcggtggcgaaggtgaccctggtccagagcgactcgatctgcgccggacggcacggggtggacacctgccaaggcgactccgggggaccgatggtgcggcgcggggcggacgggcagtgggcgcaggtgggcatcgtcagctgggggctggggtgtgcgcgcgacgcctaccccggggtgtacacgcagatctccaagttccgggcggcgatcctggcggccacccgcaaactttcctgagtggcccggcgtgcgcgggcctgccaccatttcagccatgagctacggcgtgaccccgacgcgtgtcgacgcgcccgcgaaattcggcaccgaagccttctacgcgtccctcggacgcgccttcctgaccatgtgcgcggtcatccccggcctgttcctgatcgaggcgctcgacgtggcgctcggccagggcaccctggacatggccggcggcatcatcccgcaccacctcgacggcctggacggggtgctgttcagcccgttcctgcacagcgggtgggaccacctctacggcaacgcggtgccgctgatcctggtcggcacgttcgcgatggccggcggcggtcgccgcttcctctggtcgaccctggtgatcatgctgatcagcgggatcggcgtctggttcgtcggcgacccgtcgacggtcgtggtcggggccagcggggtgatcttcgggtatctcgggctgctgctcggccgcggcctgttcgaacgcagctggtggaacctcgcggtggccgcgttcgtcgggctcctgtactggtaccaggtctacaacatcctgccgaccgatcgggcggtctcctggcaggggcacctgctcgggctgatcggcgggctcgtggccgccgtcctgttccggcgacggtgagggtctttcccgtgccggccggggcgggcgaggtgagtggcccttccgtgccgactggggacgggcgacggtgagtgggtctttcccgtgccggcccgggggatgcccgggccggcgtgcgggtcagatgatcggctcctcgccgatcgggacggtcggcaggtggccgtcgaagtcgaccgcggagtagagggccagcttctccagccggtgatacgagtcgatcacccggatcgtgccgctcttggaccgcatcacgatcgactgggtgtgcgcgccgccggagcgataccgcacccccttgagcagatcgcccgaggtgaccccggtcgccacgaagaaacagttgtcgccggtcaccagatcgtcggtggtcagcacccggtccaggtcgtggccgccgtcgaccgccttctgccgctcggcgtcgtcccgcggccacaacttcgcctggatcatgccgcccagacatttgatcgcgcaggccgcggtgatcccctccggggtgccaccgatacccatcagcacgtcgacgtcggactcggcgcgggccgccgagatggccccggcgatgtcgccgtccgagatgaacttgatcgtcgccccggcctgccgcacctcctcgaccagccgggcgtgccgcggccgatcgaggatgcagaccgtcacatcggagacgctggaccgtttggcccgggcgatccggcgcaggttctccgccgtgccggcattgatgtcgatcacgtcggcgcagtccggcccgaccgcgatcttgtccatgtagaacaccgcgctcggatcgaacatcgccccgcgctcggccaccgcgagcaccgagaccgaacccggcatacccttgctcatcagcgtcgtcccgtcgatcggatcgaccgcgacgtccacctccggcccggtgccgtcacccacccgctcgccgttgtagagcatcggggcctcgtccttctccccctcgccgatgacgacgacgccctgcatctgaatcgagttgatgagcttgcgcatggcgtcgacggcagcgccgtcaccgccgttcttgtcgccgcgtcccacccagcgaccagcggccatggcggccgcctcggtcacacggaccaggtcgagggcgatgttacggtcgagatcctggggaacccgggcaggcatgtcggcctcctcgcgtcgttgcggggctgtggatccactgatcctggcatctgaggacgtgccaagtcccggttcagcgacatggttaacaatgagcacgtggaacccgctgcccccgagaccgctccgacgccgcccccgaccccggtgacatcgccgccggcgtccgctgcggcgccctcgcccgccgcgggcccgacctccgccgccgagccggccggggccccgtcgccgtccgctcccggaccctcagccccctgcgccccgtcgggctccgcttccgcgtcgtcgggctctgcttctgtgtcgccaggctctgcttccgcgtcgtcgggctctgcttctgcgtcgtcgggctctgcggagttgccggcgtcctcggcgtcgggcgtcgccgcggagtcgtcggctgcgccggttccggccggggcgacgtcctcagcggctccggccgcgagcgcgtcgccgcggctcacccgccgggaggggcgggcgccgcgcgacatggcgctgtccctggcggtgctgatgatcccgatcgtgctgctgctggtcttctaccgggtggtgctcaacggcgacaagccgctcaccgtcgacccgtcctcgtcgttcgacctcgcgtccaggcacttcaccgtgctgaaaccggccggcctgggcaaggattggcgggtgaccgcggcgacgttcaaggatgagaagggcggcgccatcctgcgcatcggctacgtcgacccggacgacaacccggtccagctgatcgagagcaccacccccgcggacacgctcgtcccggccgaggtcggcaaggacggcaagcgcgccggcgcctaccgcaccgacgcccgcacctggatggtctacaccggccgcccgggcgaaacggccctgatcttctccgataccggccgcaccgtgctgctcgtcggcaagaccggacagcccaacctggaagccctcgccaactccctgaagtagccgtcggcggatccggtcagccggcgtcgcgggcggatccggtcagccggcgtcgcgggcggctcgggcagcgtcgatgcgggtgcgggcggagtccagccagcgctggcagatgtcggccagtttctcgccgcgctcccagagggcgagggactcctccaggctgccgccgccctgctcgaggcgggtgaccacgtcggccaactcggtgcgggcctgctcgtagctgagattgtcgtcgctcatgcgttctctcctgaggtcaccactgcggtcaactcgccctcggccaggcggacccggaccgggtcgccctcgtccacctcgccggccgcacgcagcacgtggccgtcgccgcgctgcacgatcgcgtagccccgctgcagggtggccagcggggacagcgcgcgcagccgggccagcgtgtggcgcagctcgtcgtcggcgcggcgcacccggtgctccaggctgcggccggcccggtcacgcagcgcgaccacctcggcggcgcgctggtcgatcagtgtttccgggcgggccaggaccgggcgggaacgcagcgcctcgacccgttgccgctcccggtcgatgcgggtgagcacggcccggtcgagccgctggcgggcgtggtcgatcagccggatctcgtcggccaggtcgggcacgatccgcttggcggcgtcggtgggggtggaggcgcgcaggtcggcgacgtagtccagcagcggggtgtcggtctcgtggccgatcgcgctgaccaccggggtgcgggcggcgaacacctgccggcacagcgcctcgtcggagaagggcagcaggtcctccacgctgccgccgccacgggcgatcacgatcacgtcgaccgtctcgtcgtcgtcgagcaccttgagcgcgttgatgatctggggcaccgcgttcggtccctggacggcgacgtgggcgacccggaagtcggcgcccggccagcggcggtgcacgttggtcagcacgtcccgctcggcggcggtgttctgcccggtgatcaggccgatccggccgggcaggaacggcagccgccgcttgcgctcgcgggcgaacaggccctcggcggcgagcagctttttcagccgctccagccgggccagcagctcgccgaggccgacctggcggatctcgtcggcgcgcaggctgagcgaaccgcgggcctgatagaactccggcttggcgtgcagagtgacccgggcgccctcggacaggtcgggcgcgcccgtctccagcacgtcgcggtgcacggtcaccgagaggctcaggtcggcggccgggtcgcgcagggtcaggaagaccacgccggagccggcccgccggctgatctgcgccacctggccgtcgacccagacccagccgagcttggcgatccaggcgctgatcttctgcgtcacgacgcggaccggccagggctcgtcggcggtgctcttcgccggtgcggtggcggcctgggcttcactcacccggccagactagggcagcccaccgacattctcgtcggcgcgatgctgcgccacgtacgcgtgcgcctcggcgtgccggcccacgtatccggtcaggtccaccggcgtacgccgctccgggatctgtttctcgatgaaccgggtcagggtcagcgtgaccagcccggcgcacccccagaagaccaggtcggcgccgagatagcgcaggtcggtgtgcaccccgtcgccggtgcccaggaacgggaacgggaagccgcggcgccgcggatgggcggccatgcagcaccgggtggtgaccgggatcagcccgggcccgaggccggccgggacggtgagcgccgcgaccagccaggcggcccggctcggcgcgatccggtgcagggcgagcaggatcatcccgccgagggtgacgaccgcgtggaacaccacgtacaccgggccgtcggtgccgctgaccaggtcgagcaggccgacgccgaacaggaaccagccggccatcacgcgcagcaccgtggagaccgcgggccaccggtcgtcccgctcggcactcatgaatccgattatcccggccgataccatacggacggggcgaaacggatcaacagccgttccggccggggttgtggccctgatcgcaggagggtggcggccggacggtggcacgtaccattgccgcgtgactgaagctcgtaagcgggtgttgctcgccaagccgcgtggttactgcgccggtgtcgaccgcgccgtgcagaccgtcgaggaggcgctgaaactctacggcgccccggtctacgtgcgtaagcagatcgtgcacaacaagcacgtggtcagcacgctggaggcccgcggcgcgatcttcgtcgaggagaactacgaggtgcccgagggcgccaccgtggtgttctccgcgcacggcgtcgcccccgaggtgcacgaccaggcccgcgagcgccggctcaaggcgatcgacgcgacctgcccgctggtcaccaaggtgcaccacgaggcgaaacggttcgccgccgaggactacgacatcctgctgatcggtcacgaggggcacgaggaggtcatcggcacctccggcgaggccccggcgcacatccagctcgtcgacggccccgacgacgtggcgaacgtcgtcgtccgcgacccggccaaggtcgtctggctgtcgcagaccacgctgtcggtggacgagacgatggagacggtggcccggctcaagacccggctgccgctgctgcagtcgccgcccagcgacgacatctgctacgccacctcgaaccggcagcacgtgatcaaggagatcgcgccggagtgcgacgtggtgatcgtggtcggctcgaccaactcgtcgaactcggtccgcctggtcgaggtcgccctcggtgccggcgcccgggccggtcacctcgtcgactacgccgccgagatccaggacgagtggctggccggcgccaccacggtcggtgtctcctccggcgccagcgtgccggacgagctggtgatggaggtgctggcgcacctcgcggagcgtggcttcggcgaggtcaccgagttcaccacggccgaggagcggctcaccttctccctcccgcaggagctccgcaaggacatgaaggccgccgaggcggcccgggccgctgccgccggctgaatccccgaccgggcgcggccggtcgaccgcgcccgggtcgcgacgctgcggtcagctgagctccgcgggccggagcacggcggtcagctgagctccgggtcacgacgctgcggtcagctgagctccgcgggccggagcacggcggtcagctgagctccggggcctggggctgccgcggggccacctcgatctggggcggctgcggcagatcctcgtcggaaacccccatctcggccagcttgcgtgcgctgaccaggactctggactccaaagagccgattgccttgttgtacgcgctgaccgccccgttgagggagacgcccaggcggctcacgtggtcgcccagcgtcgacagccggccgtagagctcgcgggccagcgtgtgcacggcgaccgcgttgccggtcagcgtctcctgccgccaggagaacgcgacggtgcgcagcatcgcgatcagcgtggccggcgtggccagcacgacgtcgcggcggaacgcatactccatcaggaccgggtcgcgctgcagggcggcgtccaggaacgggtcggccgggacgaacagcaccacgaagtccggggtggaggggaaggccgaccagtactccttggccgacagggcgtccacatgcgctcgtagatgccgggcgtgctggtcgaggtggagatcccggtcacgttcgtcgcgggcctccatggcggacagatagccctccagcggcgccttggcgtcgaccaccacggtgcggccgccgtgcagccggaccaccaggtcgggccgcaccccctgacggtcggtctcggcggtgacctgctcggcgaagtcgcagtgctccagcaggccggccgcctcgacgatccggcgcagctggtgctcgccccagcggccgcgaacctgcggggtgcgcagcgccgagaccagttgccgggtctcgccgcgcagctcggtggagaccacgcccatcgcccgcacctgctcgcggagctcggcatacgcgtcgacccgctcgcgttccaggtcggcgacccgctgctcgtagcgtcgcagcgtgtcctgcagcggggcgaccgcgcgggccaccgcctcctgcgactgggcggtcgcctcataggacagcgcccgcatcgactgttccagccgctgctcaccatcgcgggcagcggcgaccgtggcctccagccgggcgatgtcggtggcggcccgcgcccgggcggcgagccagcccagggcgccgcccgccgcgaggcagatcaggatcacagcgagcgtcgagtacgtcaccaccgcagattgccagaagggtacgacaagaccaccgcgggtactttggaaaacatgaacggcgtgttgctcatcctggccatcgtcgcgatcgtcgccctggtcgtcgtcgccacccagcgtggcggggcaagaaatcagcagacccagctcgcggatgcccgtgccgacgcgcagcggtggtacgagcggctcggcggccagatgatgaacctgcacgccgacgagccggccgcgcggcaggccctggccgacgccggcgagcgctacaacgcggccggcggccagttgcagcaggccacctcggtgcggcagttcgagctggcccgcgagtccgcgctggagggtctggcctatgtgcgggccgcccgcgtcgcgatgggcctcgacccgggccccgacctgccgccgctggccgcctcgcggggcaccgggcagctcacccaggagcgcgaggtcagcgtgcagggccacgcttaccgggcggggccgcagccgggcccggaaaccccgtactactacccgggtggccgggtgcagggccgtccggtcccggccggttggtattcgacaccggtctggaagaccgcgctcggcaccggcgccggggtgctcggcggcatgctgatcttcgacgcgctgttctcgccgtccttcggcgacgtcgggtacgccgacggatatcaggacggcctgctggcgggcaacgacttcggcgacgcgaacggcctcggcgacctgggcggcaacgacatcggcggtgacttcggcggcggcgactggggcggcggtgacttcggcggcggcgatttcggcggcggcggcgacttctgaccccaccgacgcggcggcccgcccgggcgcggcgctgatcgctgagtgcgacagccggtccggggatcgacggggcgctgatcgcggagtgcggcggccggtccggggatcgacggggccgctgatcggtgcgtgcggcaggctgacgaggctcggcggcgagttccgcaggagcggccggcgtgctgtcggcgtaccggcgccatcgcggtccggcagcgggaggaccgcgaccggaccgccggcgtttagcgggctgctaccagggttgttcggggtggagcggggccggccgggggtaagggtgcaggcggcgggtgagctcgtggcgcagcgcccgcggactcggccagatctgggtgaggtcggcggcgaacgccgggccgcgcgcggtcaccgtctgctgcggccagcccgcccccgagccctgcaccgggtgcaccgcgtccatgtcgaccggggtcacctccagcacggttcgcaggccgctgcggcgcaccgtcaccgcggcgatgtcctcccaggcgagcagcaccggatcgctgccctgcgcggcgagttccagcccgccggccgagacccgcacccaggtggtcagcgccgagcgcgctgacaatgcatagaacccggcgaccgccgcgccgacgactaccgcctgcagcgtggtgacccaccagggatcaccgccgccccgcgcgatccgccccacgatcggggagaccaccaggtacgacagcatgagcacggcgaacaccgcgaggaacgtgcgggccggcgacgaccggaacaacacggcgtcctcggccggggcctcgacctgctccggtgcgatcggcatgcttcctatggtggaccggaccacgggttccgctcccgggatcgcggcttttgccgccggccgggcgggcccgccgttaccgatggcgaacggggagggcgaatgacggagtcggtcagcgtcgcggtggtgggcgccggcagccgcggcggcatgtacgcgcgggtggccgcggacagcggccgggcccgggtggtggcggtcgccgagcccgacgacgagcggcgggaacgtttcgcggcggagttcggcctgccggcggaccgggtccaccgggactggacgggcctgctggccgggccgcgggtggccgacgcggtgatcgtggcgacccaggaccggttgcacgaggcgccggcggtggcgctgctcgggcacggttacgacgtgctgctggagaagccgatggcgccctccgaggcgagcgcccggcggatcgccgacgcggcgctggccagtgggcggatcttcggggtgtgccacgtgctgcggtacaccccgtacaccgcgatgatccgcgagctgatccgcgacggcgcgctcggcgacgtgatcaacgtgcagcacctggagccggtcggctggtggcaccaggcgcacgcctatgtgcggggcaactggcgttccgaggcgggttccgggccgatgctgctgaccaaggcctgccacgacgtggactggatcatgcacgtggtcggggacggcgtggcccgggtgtcgtcgttcggtgggctcgcccatttccggccggaccgtcagccggccggggccgcggaccggtgtgtggactgcgcggtggagcgggaatgcccatactcggcgaagcgcctctatctcggctgcctcggcgacccgaagaccgagcggtggccgctggggccggtgacctcggacgccaccgaggccggggtgctgcacgcgctgcgcaccggaccgtacggacgctgcgtgtaccgctgcgacaacgacgtggtggaccaccaggtggtgaacttcgagttcgccggcggagcgaccgcgacgctgaccatgaccgctttctcgccgtccgacggttaccggcgaacgcggatcttcggcagtcacggcagcctcgaaggggacgggcggacgctgaccctcaccgatttccgggacggcagcgagcgggtgatcccggtgccggccggcgccggcggcaccgcggccggtggccacggtggcggcgacgccggcctggtcgcggcgttcctgaccgcggtgcggacccgcgacgagtcgtatctcggctccggtgcggccgccagcctggacagccaccgcgtcgtgtgggccgccgagcgggcccgccacaccggaaccgtgatcactctctgactccctccgctggtggacggcgctttcagaaggcgcaggcgatgaccagctccggggtccggtcccggagcaggtcgagcttggcgatccgcccggcggcccggacgtccccgccgatcagctccagccgatcgagcagggcggccgggccgagcgcctcggccagcggcacgtcggcccgcatcgacagccggcggtccgatttcgccttgcggacctgccgcagcgcgtcgccggccaggtcgagcagggccggctcgctgtccggcgcgacccgggtcagctcataccgggtgggccaggtcgatcggtggaccgatccgtaacgccaccacgaccagacctcctccgtcacatacggcaggaacggggcgaacagccggagttggacggacagcccggtggccagcgcggcgtgcgccgagccggcggccgggccggacccgtacgcccggctcttgaccagctcgatgtagtcgtcgcagaacgtccagaagaacgtctcgaccgcctgcagcgcctccgagtgctggaaccggtcgaacgcctcggtggccgcgatgaccacctcggccagccggcccagcatcgcccggtcgagcggctcggtgaccggctgccgcagcgcgtcggacgcgcccaggcggagcgcgaatttcgacgcgttgagcagcttggtcgccagccgccggccgatccgcagctggcccggctcgtaggcgatgtccgccccgggccggccgctggccgcccagtagcgcatcgcgtccgcgccgaactccgccagcggcggcccggccggcaccgcccggccccgggaactggacatcttcttgtggtcggggtcgaggacccagccggacaggaccgcggtgtgccagggcagcacgccgtcctgctgctcggcgcgcagcaccgtgccgaacagccatgtccggatgatctcctggccctgtggtcgcaggtccatcgggaagacccgggagtacaggtcgtcgtcgacgctccagccgccggcgatctgcggggtgagcgacgacgtcgcccaggtgtccatcacgtccggatccgcggtgaagccgcccggccggccccgcgccgactcgtcgaatccgggcggacagtccgaagtcgggtcgaccggcagtgccgaatcgtccggtatgagaagctggtcgtagtccggctcgccagcgtcgtcgagccggtaccagagcgggaacgggacgccgaagaaccgctgccggctgatcagccagtccccggtcagcccggtcacccagtgctcataccggtggcgcatgtgctccggaacccagcgcaactcccggccccgggccagcatccgctcgcgcagcagcgggtcgcgcccgccgttgcgcaggaaccactgccggctggtgacgatctccagcggccggtcgcctcgctcgtagaacttgaccggatgcgtgatcggccgcggctcaccgagcagatcacccgacgcgcgcagcaaccggaccgtttcccgccgggccgcctccacggtccgcccggccagcgcggcgtacaccccggccgggacaccggacggcgcatcgcgcaggaaccgcccgtcccggccgacgacgacccgggtgcccaggcccagatcgcgccaccaggtgacgtcggtcaggtcgccgaacgtgcagatcatcgcgatcccggtgccccgctccggctcggccagcggatgcgccaggaccgggacctcgaccccgaacagcggcgaccgggccgcggtcaggtgggcgaaccgctggtcaccggggtgatggacgagcgcgacgcaggccggcagcagctccggccgggtcgtgtcgacctcgatcggcccgtccggcccagcgaagcgcagcgtgtggaaggcgccgggtcgctcccgatcctccagctcggcctgggcgaccgcggtctggaaaccggcgtcccacagcgtcggagcctgcgccgcataggcctgaccgcgggccagggcagccaggaaggctcgctgcgagacggcgcgcgcccggtcgccgatcgtcgtatacgtcagtccccagtcgacggagaggccgagccgccgccagatcgcctcgtaggcctgctcgtcggcagcggtcatccgcgagcacaactcgacgaagttgcgccgggagatcgcgaccggcgggtcggccggagcctccggcggctgccaggccgggtcgtagggcagcgccggatcgcagcggaccccgtagcggtgctggacccgccgctcggtgggcaggccgttgtcgtcccagcccatcggatagaagaccgtcttgccgcgcatccgctggaaccgcgcgaccgtgtcggtgtgggtgaacgagaagacgtgcccgacgtgcaacgcacccgatacggtcggcggaggggtgtcgatggcgaacacgtccgaccgctccctcgaccggtcgaacgtgtaagtaccctcctcctgccagcgcggcgcccagcggtcctcgagcccgtccagcgacggccgctcgggtaggcccgggcggcccgttcccgtatcagtcatgcggccagcctaggggcgccgcgatcgggccggccaggcaatttcccgcctgtggacaaccctcccaacaggacgggtcaggctagtctcggtgcccggaggcgccgatgacgatccagccgctgtacgtgctgtgcgacgtctcgaccagcctgcccgcaaagctcgggccaccgccgacctgctcctggcgcacctgtccacgcagctcaccggcggcgtcgagctgaccgcggcggtccgctggagcgtcgagctgcacaccggcgccgacgacctggtcccgctcgtcgtcagctgccgcgcatcgtcgtcggccggattcagccgggccagttcctcgctcgccgccaaggcctccggcggctgccagtccggtgtgtgcggctgcctgccgaaaccgcgcgactgcccatcacccggacactgtccacatcgaccaccagtgccgcggatccgtgtcgtagaggacgttgcgcccggagatgtcgccgaccacgacattctgggcatgcttcatcgtgtacgccgcggccaccgcccggaccagacccagccgcgccgtcagatccaccggcggcagacccgtccgcgccgccgtcatttcgtgtgcggtggggccatcgaatacgacacattgaccaacagatagaaaaccgacgcgagagtacggtcgtcgatcacggcaacttcctcacggcagatcgccataacggcggacatgcgccagcatccggctcaccccaccgacccgcagcgcggcctgccgggcagcccggaacccattgccgtacaccggatccgggttgtccatgatccggcggcgttcccactccgccggcgcacccggctcccccttcaaccaggcatgcgccagcaactcgcacagaccctcctcgaccggcggcggcaactccccgaaaccgtgctgcaccagataggcgtgcatcacctcatgcgcgaccaccgcgccgaaacgcaccagcggcagatcccggacgaccatcagatcgaccacctcggaacccacacacaccgtcccgccgagcaatgcacccgacccgtgccaatccgcctgcaactcggccaccggcaccagacgcacccgcaccggcttcgtcgtccagatcgacaacgcccgcaaccgcgccgcgatcggcggcaacacccgccgcacatcctgctgcgtacgcaccgccgtcgccgcgcaccgcggacacaacggacgctccgcggccagcgtcggatcagccggcagaccacaacacgtcgacggctgctcatgagcatgccgatgacagatcaactcaccgttgggcgtgacgaagccggtcagcgtcatcagccggccacagaccgcacaccgaggcagccccacgccgtcagtgtgcgggcccggcgccaccccggagtcacgccgacgactcgtgctccagaagccacgacttcaccggcagaccccaccggtaaccacccaacgaaccatccgtccgcaacacccgatgacacgggacgatcaacgcgaccgcattccgcgcacacgcggcggccgccgcgcggatcgccgccggacggcccgccaacacggcatagtccgcatacgtcaccggatcacccggcttgatgtcgcgcatcacccgccaggcgtgcgccaggaacacgccgccggtgcgctgctcgaccgcgaccgtgtccagagccggaaggtcgccggcgaaataggcacggaccgcggcctgcgccgggccgacatcgtcggcaggctcggcgggctccaccagggccggatcgatcagacggatcagggccgggacatcgacggtgaaaccggcggcgcggacggcacctgaatccgcgacgaccagggtgaacgggccgggcggggtgtccatcgtggaaaaccgcaacatggtgatcagctccttggatcagagggacagcgtggcaggaaaagcgggacggcgcggtggcctgtggacaacgggggagggctgtggacaacccgggttgaggggcgcggagaggcgtagcgttcaggcggcccgccacagacggatcaaggcgtacgagcgccaggggcgccagcgctcggcgtgcacgctcagggacccggcggaatcggggaggtgcaaagcggcggctccgcgacgggcggccaggtcggtggggaggaagacgtcggggtcgccgagagcgcgcatggcgatgtaaccggcggtccacgggccgatgccggggatagccagcagacgggcggtggtttcgtcgcggtcggcggtggggttcaggtccaggtggccggaggctacggcggtggccagggcgcggagggtggcccggcgggcggcgggcatgccgaaggccgcgtcggggagtgcggcgatggtggccggggtggggaatccggtcagatcggtggtggcggcgggggcgggggcggggcccgaagggccggagtctccgagccccccagaactccccgaaccccccgaacccccggcagccgcccgcaccaacctccccagaatcccccgagccccagccacactcacctgctgccccaccaccgcccgaacagccatctcgaacccgtccaccgcccgaggcacccgcaccccaggctcttcccgcaccacctgttccagccccggatcggctgccagcatcccgtccaccgcatccggatccgcgtccagatcgaacagccgccggcaccgcgccaccgccggcgccagatcccgcacatcgccgagtcgcagtgtcgcgaagacccatctgtctccgggccgcagcaccacgtctcctgttccgtgcggcagggtcagcccccgccggtatcctccgtcgacgatctcgtccactcccggcagtgttcgtgccccgaggaaggcgagcagcgacgccgagtgcagcggcgcccgatatgccagccgcaggttgatgacgccggcttccccgcgggccacgggtcgcttttcgcggatgcggctcggcgattgcgcgtacacctcgagcatcgtgtcgttgaattgccgcacgctgccgaatccggccgcgaaggcgatgtccgcgagtccgaggtcggtcgtttccaccaggatccgcgcggtctgtgcccgttgggcgcgggcgagggcgagcggtccggcgccgagttccgcggtgagcatccggttgaggtgccgctcggtgtagccgagccgggtggcgagtccgccgacgccttcccggtcgacgacgccgtcgccgatgaggcgcatcgcgcggccgacggtgtcggcgcgcacgtcccagtcaggcgatccgggtgccgcgtcgggccggcatcggcggcatgcccggaatccgccgcgttgcgctgccgcggcactcacgaagaatgtcacgttttctcgtttaggtgtgacggccgggcaggagggccggcaatagatcccggtggtccgcacggcggtgtagaagcatccgtcgaaccgctggtcacggctgtcgacggcgcggtagcaacgctcgaagtccagctccatgccccgagtctgctctgtccgccggggcttcggctggcggctttcggacatcacggttcgcggaccggtcaccggccgctgccggttgccgccgtcgatggggtgtacgcggtgagcaccaccggtcctcccgatgtcaactgcggttgacgccggccgtgctgtcaactacggttgacgacatggaggctttggtgagcacggacatccggtggcggaccttcggtgacggtggccccaaggtcgtgctgctgcacggcggactgcagacctcggcgaacttcacgaagctggccggcgcgctggccggcgacttcaccgtgtacgtcccggatcggcgcggccgggcactcagcggaccggccgtggcggggcacgggctgcgcgccgagatcgacgatctgggtgcggtcctcggcgagaccggcgcgcgcaacgtgttcgggctcagttccggggcggtggtggcgcttcgggcggcgctcgagctgccgatcgagcggctggcgctctacgagccgccgctcaagcacggcgggcacgacccggtcgcctggctttcccggtacgaggcggagctggcccggggacgcaccgcggccgcgttcaccacggtcgtcaagggcaccggcggcgcgcggtatgtgccccgggccgcgatgctgccgctcgccgggttggccgtgcggaatccggacatcgccgcgctggtgccgacgatgcggctggacgcggccgtggtcgaggacgcggccggcccgctgagcacgtattccgctgtcccggcggacacgttgctgctcggcggcgaccgttcacccgcgtacctgcgatccgtcctgaacggtctggagccggtgctgccgcgggtctgccgggtgaccttgaccggtgtcgggcatttcgccgccgacaacagcggccggcccgcgctggtggctgccgaactgcggaagttcttccgatgaggcttgcgtagactggcgttccgtgagcctcaccatcggaatcgtcggcctgcccaacgtcggcaagagcaccctgttcaacgccctgaccaagaacgacgtgctcgccgcgaactacccgttcgcgacgatcgagcccaacgtcggcgtggtcgggctgcccgacgagcgactgggaaagctcgccgagctgttcggcagtgagaagatcctgccggcgccggtgagcttcgtcgacatcgcgggcctggtccggggcgcgtcgaaggggcagggccggggcaacgcgttcctcgcgaacatccgcgacgcgtcggcgatctgccaggtggtccgcgcgttctccgacccgaacgtgctgcacgtcgacggcaaggtgtcaccggccgacgacatcgagacgatcaacaccgagctgatcctggccgacctgcagacggtcgagaaggcgctgccgcgcctgcagaaggaggccaagctcaagaaggagaaggccgccgcggtggccgccgccgaggcggcgttccaactgctcaacgacggcgtcacgctctaccagggcgccacggcggcgggcatcgacctcgacctgctcggcgagctgcacctgctcaccaccaagccgttcctgtacgtcttcaacgtcgacgaagccgagctcggcaacgagagcttcctcgacgagctgcgcgccctggtcgccccggccgaagcggtcttcatggacgcgaagatcgagtccgagctgatcgagctcgacgaggcggaggccctggagctgctgcagtccaccggccagtccgagcccgggctgaaccggctgatccgggtcggcttcgagaccctgggcctgcagacctacctgaccgccggcccgaaggaggcgcgcgcctggacggtcccggtcggcgccaccgccccggaggccgccggcgtcatccactccgacttccagcgcggcttcatcaaggccgagatcgtcagctacgacgacctgatggcggccggctcgatgtccgcggccaaggccgccggcaaggtccgcatggagggcaaggactacatcatgaaggacggcgacgtcgtcgagttcaggttcaacgtctgatccgatggaatgggtcttcgacggcgagatcttcgagtggcgcgggccggcgccgttcttcttcgtggccatgcccgagtcggacagcgccgagctcaaggatgaggcccgctcgctgatctactggggtcagatcccggtgcacgtcgtcatcggggacacggcgttccggacggcgctctttcccaagaacggccgctacctcgtcccgctcaaggacgctgtccggtcggcggcagggatcggcgaaggcgatctgatcacggttgccttacgtccagcctggccgtccgatgacgctcccgggtgaccctcgaggaactcgtcggggtcggcgctgtgggcgtccggccgttcgtgtttgtggctctggtcagctcgagcggccggcgaccaggcgatccaggtccaacgtgatcgggaagggcgccatggtgtgcagtttgtggcggtggacctcggtcagggcgtacaagccggtcgcattgtcgcggtcatacgcgtagacgaccggtgacccgtcttcttcctcgacgagccagtagtgcgcgatgccggcctccgcgtatttgcggagcttgaccgtccgatctcggtatgccgattcgggggagaccacctcgcccaccagaagcacctggtcgggcgtcaaaaaggtgctgttccagtcataggggccggtggtgatgagaatgtcgggctcggggcgattcagttcgtcgagccggatcgtgatttcccgctctgccccgatgccggccggtgtctggtccgagagaacgttgaccagtgcggtgatgagtcgagcgtgccagatccgctgaggggacatcatgaagacgagggccccgtcgatgagctcggtgtgtcgcggcacctcggggaggtggtcgaggtcgtcggcgagccatccctccgggcgaggtggacgcatccactcgggcaccgtgctcatgtcgccaccgtagcaagtgcgcccagcgggtgcgtgtcgcctgattccgccctgcatgcggaaaccgtagggcctggcgggccggtctctgccattcgtggatcgccgatcacccgatgggtcataggcgcttgtctaagcggtgtcccgttcggtgaaggtggtggcggatggttcgcacggcgcccgcgcggcgctgagccgggtggggtgggcggggctgccagaatggcgggatgatcaacgccggggagcgggtggctcggatcgtgtcggaggtgctggcgccggcggtgctggtggcggcgctgctgatggtggtggggtggcatgccgggcagacgcccggggtgtcgcggtggtggggactgccgggggcgatcttcgcggcggtgatcccgctgggctatgtgctgcacggggtgcggaccggacggctgaccgaccaccacatcccggaccgggcggatcggcgggtgccgttgctgttcgggatcgtgtcgctcggggtggggttgatcgttctcgtgctgctcggggcgccgcgggaggtgctggcgctgctgatggcgggcgccgccgggctggtcgtgttcgcgctggtgacgcactggtggaagatgtcgatccatgccggggtggcggccggggcgctggctacgctgaccgcggtgtacgggccggtggtgctggccggggcgccgctggtgctgctcggcgggtgggcccgggtgcggctggccgcgcacacgccggcccaggtgatggtcggtgcgctggcgggcgcggtggtggccggcacgatcttcccggcgttgcgctgaccgggccgcgagaaacggggcgggagagcggtcatgggctggacgatcgaggaacgcgcgtgggacgacccggccggggcggcgctgcggctggcgcagcgcgccgagctggacgcccggtacggcagtgacgaccacgagccgggcggcgcgccggccgctgacgagatcgacgtgttcctggtcgcggtcgacggcgacgcggcggtcggttgcggtgcgctgcgccggctcgacgagcacagcgtcgaggtgaagcggatgtacgtcgcgccgggcagccgtggttccggtgtcgcgaccgcgatcctgcgggcgctggaggacgccgcccgccggcgcggctggacgacggtgcggctggagaccgggacggagcagcccgacgcgatccgcttctaccagcgtgagggctaccgggagatcccgttgtacggcaggtatgtgggttccacgatcagccgatgcttcgaacggctgatctgagagagcccggtcagatctcggtcgccatcgccgagaacgcggccgccagcttcgtcaggtccaggtcgccgaggtgatcgaagatgtgccggcgcacgctggccaggtgggtgggccaagcctcgcgcaggcgggccaggccggccggggtgaggacggcgttggcgccgcgggcgtcctcctcgcagcggatccgcttgacgtagccgagggattcgagtttcgcggcgagccgggtcatgccgctgagcgacatgtcgcaggcggcggcgagttcgctcatccgcatccgctggtcgtcggtttcggacaggtgccgcagcaccgagtattcgctggccgacatgcgctgttcgcgcatcaggtcggcgtcgagtgcccgcggcacgacgaggaggaaccggccgagcgcgcgcatcgccgcttcctccgccgggctcaacggtacgagatgtccggtggtcgcaggcatgcctgtgatcgtacggcggtggcgcatcccgttgaccttgcgaccggtgtgcagacaccggcccgtagggggaacgcgccaggagcgtgacgggcactgcgggtcagcttttcgggggaccgtcatgtgcttgcctcggcttccggacaagacacaatgctttggtgcaaaaccagacaactagtgactcatggcagcatctgctcgaaatgccacgaaagtcttggtgggcccgcctgcccttcggcgtccgcatgatcgccggcacgtcagcgctgctcgcgctggtcagtggtgggttggccggcgccgccgtgctgaacggcaacgacgggcagtccgccgagagcgccgagcagacactggccggcgacccgggcgccgcgcacctgcaggacgacccggaggtcgtcagccgggaggcggcggccgccgagccgctgccgctgcggcgcacccacctgccggcgccgccctagctagctaggggagtggccccgaccgccacccagctcccggtcgcgaccggtgccgagctgcagcgggcgcgcgccgaggacccggccgaccggaccggcacccggtccccgcgggtggctccgaagcccaccgtgaccggccgggcgaagccggtggtgaccacccggaccgacaccgagatccggcccgtgccgttccgcacccgggtggtgcgcgacgacacgctgccccagggcttccaccggctgcagtcgcccggcgcgcccggcgaggagaaggtccgctacctggtcacgctgaccgacgggcggccgaccgggcggcggctgctggacaccacggtcacccggcagccgcagccccgggtggtggtcctgggcacccaggactgctccggtgcgttcgacctgtgcgtgccgctgggccggtccgcgtgcccgagcgcggcgccggtgcccccggaaccggacgtgccgccggtcgcggaggactcggcattgctcgacgtgcggctggagcccgccacggcctgctagaggtcatagggttggcggcatggcactcaccgacgccgagctgaccgagatggcgcagcgcctgaccaccgttccgggcgtggtcggggtcgtgctcgggggcagccgtgcccggcagacccactcgccggagtccgacaccgatctcggcctgtactaccgggccccgttcgacaccgtccggctcggcgagctggcggtcgaggtggccggcgaccgggcccgggtcaccgcgcccggcgagtgggggccgtgggtggacggcggcggctggctgcggatcggcgatcatccggtcgactggatctatcgggacctggaccgggtgcacgcctgctgggccgaggccgagcaggggcgctacgagttccacgcgcagggcggccacccactcggggtgccggatcatgcgtacgccggcgaattggccctgggccggatcctcgccgatccgacaggggagctggccgcgctgcgacgccgcgtgtcggttttcccgaggccgctggccgaggccctggtggccgggttgtgggaggccgacttcctggtcgggctggctcgcaagggggtcggtcggctggacaccagctacgtggccggctgcctgttccggttggtcggggtgtgtgcgcacgcgctgcacggggcggccggccagtggctgatcaacgagaagggcgcggtggcggcggccggccggctgcccggcgcgccggcgcagttcgccgaccgggtggacgccgccttcgccgcgatcaacaacgatccgctgcatctgacactggccatcgacatcgccgccgatctcgtcctggagaccaccgaggcgtgcgcgatgatgttgcggtgaccgctgacgtccccaccattctcgccaccagcgccgggttcgaacgcggcccgctcggcggcttcgacatccgtcccggccgggtccaccatttcgcggccgagctggcgaatgcgggcgccgatccgcggatctgcgtgctggctcaggcgctgggcgacccggaagcgcggatcggcgcgttctactcggctttcgcttccaccgcgttcacgatgtcgcacctgcagttgttcccgatgccgaatgtcgaggacatccgtgcccatctgctcgcgcaggacgtgatctgggtggacggcggcagcgtggcgaacctggtcgcgctctggcgggtgcacgggctcgacgagatcctgtacgaggcgtggcaggccggagtggtgctcagtggctcgtcggccggctcgatctgctggcacaccggcggcaccacggacagtttcggattgcggctgcgcgcgttcaccgacggactgggctggctgccgtacagcaatggtgtgcattacgacgccgagggggagcgccggccgaagatgcacgagctgatcgccgacggcaccctgccggacggcttcgccaccgacgagggtgccggcttggtgtatcggggcacgtcactgcaggaggtggtggcggaccgtgcaggaccacgcgggtacgccgtgcagcgcaccgccgcgggcaccgtgaccgagacgccactgcccacccgcgttctcccggaatatcgtcaccgatcggcataaactgcgggtggaccacaaccggacaacggtcgattccgttgtctgctgcggagtcaacaccagagggagaccgatgaggccgatcgcgaagcgtggcggcgagggcggcagtttctgacccgtccggggtgggggtcaggacagcgcgacggtggccagcccgaccagcacggccgagagcagcagggccaccgcgtagaccgcgttcgccccgagcagcagggccagccggtgcggctgacccccctcccctccgccgcccgccggcgccggagcgaggtcggcgccgagcagcatgccgctcggtgtccgggtcagcggtttctgcagatgggccagcaccggtgatcgcctccgggggtcaggggcatcgataggctttggtggaactttcccggagaagcatgcggcgagccgggtgagaccagcaatggttactcgcgggtaaccgttcgcccggtggccgttctggcatgccggctcccccgtacggctgtcgaacatcggtcgaacagtcgccccagatcgggcaacgtcactctttttcgggatttgtctggcgggcttgatcgtccatcatcgggatgatgctgacgatgccggccaagtatcgaaccgtgttcgggggcacctggggcctgctgtgcgcgctcctcggtgcggcctccggcgtcgcccagttggccggcatctccggccggaccggtcggtgggcgctcaccgccgtcttcctcgcctgcctgctctacttcgtggtctggttctggcagatcgccttcgtgctcaagatccgccaactgcgcgccgaactgctcgacgcgacgcaggcactcaccctgcagcgggccggtcaccagcactatctcgacgccatccagcggatcagtgagcgggagaagccgctgttcctggagaccttggaggtgctggtggcggtcggcgccgacgacgacagcgaccggatcgtggagaagcgggtgaccaccccggagccgctggtcacgcaccggaccatgcggccgatcgtgccgaccgacgaggagcggatgatccggctcgacgacatcgcgttcaaggccagccgggagacgttcgggacgatcaccgcgctgccgctggagcagacccggacgctgcgcgtgtggatgatcttcgacccggcgatgaccacgccgaccgagtggcaggtggagtaccggccgcgcgggctctggcggccgctgcgcgagcgcggctgggaccagctgacctgggaggaccggctgccgacggcgagcggcacgccgtccgcgttcacccgcttcgcgatcacgttcacgttcccggacaacgatcagccgccgagcgtcaaggagcggcaggggtacggcgtgctcagcgagccggtgcgcgacccgtccggccgctgggaggtggtgtggcgcgacgagaggccggccggccgccggtacgtctgggatctgacgcaggcggtcggcaggccgtcgtgaggggtcaggaggcgaggctgaggatcaggttgtgcgcgtggtgggccttgtccgagccgcggaactcgacctcgtagacgtgctggcccaccgtgatcgcgatctcgccgctggagaagaactggccggcccagctcttgttgctgaccacgctcaccgagctgaccttgctgtacgggatgctggtgatcgcgaacttcttaccgacgaacgacttgtcctgcaggatgatccggcgggtggtcaggccgaggaagccggtgccgacgccgatcgcgtcgtagaccgcgatgatggtctcgccctcgagcagtccgctctggacctgctcgagctggctcttgttgtcgtagatcacgtctgccatgcggcgcagcgtagccgggccgggctacgcgtggccgaccacggtgcggtagaaatcctcgatccgggcggccagggtgacctcaccgtcggtgagtgcctcgccgtcgcggtcacccaggcagatctgggtgtgcccgtcgacccgccggatcctcgggcggatcgcgagggtgtcggccgccaccttgatccgctcggtcagcgcggcgtgctcgctgtcgtcgcacgcgagatcgcggcgcagttgcaccccgtcccgggtccacccgccgagcaacgcgagggcgtcactcagatagtcggagccggtactggtccggcgtttcctagcccgcatggccgcaccccccaaagcgttgttgccggcttgtggccgaactgtcgccgtgtcgtcatggtcggtaggcccagtctcgtccgttgagacagtgatgtccacgcccacatatccgcgtttgggggacgatcggggcggctcgggcaacctgatcggcggagttttgtgcgatcttggatctcatgccgtcggaacagtacgtcaagtccccgccgtcacccagggtgattgtggcggcagtgatcatcgtgggcgggcgggtgctcgcctgccagcgccgcagcccgcccgaggcggccggaaaatgggagttccccggcggcaaggtcgaacggggcgagaccgacgaggcggcgctggcccgggagtgccgcgaggagctcggcatcaccgtcgaggtcggcgcgcgggtcggccccgacgtgccgctggcccacggccgggccgtgctgcgggtgttcgccgccgaggtgctcgacggcggcgtgcccgaggcactcgagcacgccgacctgcgctggctgaccgtggacgaactgggcagcgtgccgtggctgcccgccgacgtgccgattgtcgcagaacttcccgctctgatggactagacggcgttgccctgctgtttatgcgaatactgcttgcgcagctcccgcttgagcaccttcatgctgggcccgagcgggagcgactcggcgaaccggacctgcctcgggtacttgtgcttgcccaggcgctcccgcgaccagtcgatcagctcttgctcggtcaggccgccgtcttcccgcaccaccaccgcgcagatctcctcgccgtgcgtgtcgtcggccaccccgatcaccgcgacctgctggatcgccgggtgccgggccagcacctcctccacctcgcgcgggtagacgttgaagccgccgcggatgatcagatccttggtccggtcgacgatgctgatgaacccgtcctcgtcccgggtgcccaggtcaccggtgcggaaccagccgtcgacgatcgcctcggcggtcgcctccgggcggttcaggtatccggcgaagacgttgtgcccgcggatcacgatctcgcccagctcaccggtcggcaggaactcgatccgctcgggtacctccgggcgggcgatctccacctcgacgccccagatgggatggcccacggtgccggccttcgccccgtacgccggctggttggtggtcgccgtgggcgaggtctcggagagaccgtagccctcgaagatgtgcgacccgaacgtctcggcgaaccgctccagcacggccaccggcagcgacgccccgccggagacgcagagcttgagtttcggcagccgctccgccttcgcggcggcctccagcagcccgatgtacatggtcgggacgccgtggaagatcgccacgttctcccgcagcatcagctcgatcgccgcctcgccggtgaaccgggggagcagcaccagggtgccgccgaggcggaacgtcgcgttcatcccgaccgtctggccgaacgtgtggaacagtggcaggcagccgagcaccacgtcgtcgccggtgatcgggtgcacgtcgaacacgttgacggtcgcgttcatcaccaggttgaggtgactgagcagggcgcccttcggcttgccggtggtgccgctggtgtacaggatcaccgcgacgtcctcggcctgccgggtcacgtaggtgtgcagcgccgggacccgggcggacacctcctccagccgctcgggcagcgtcggcagctcggccggcagcggaccgacgttcgccaggcgggtcccggacagctgcgccgcggccgcgcccacctgcaggaacgccgagtgggtgacgagcaggtcggcctggctgtcggacagcacgtaggccacctccgccggctgcagcagcagcgagaccggcaccacccgggcgcccacggccagcgccgcgtagtagacccgggggaagtcggccacgttcgggatcatcacggcgaccgtggagccggcgccgacgcccagctcgcgcaggccggccgcgtacgcccgggtctggtcccagagctcgcggtaggtgatccgggcgcccgcgtcgacgatcgcgaccttctccgggtaccggcgggcgctctcggccagaacggtggccagggacagagtcgtcatgcagatcgcctccgagtgatgtaggtcgcagcttgcgcataaactagcggcgtaagtttttgcgcgtccagtgttgattccggatttccagggagttgccatatggctcggccccggcaggcgctcctgacccgtgagcgcatcgtcgaggccgcggcggcgctgatcgacgcggagggcctggaggcactgtcgatgcggcggctggccaccgagctcggggtgcagggcccgtcgctctacaaccacttcgccaccaaggccgagatcgtcgacgcggtcgccgaggcggtggtcgcccaggtggacatcggggtgttcgccggttgcgactggcgcgacgggctgcggctgtgggcgaagtcgtaccacgcggtgctgaccgcccaccccaacatcgtcccggtgctggccaccgggcccggccggcgcccgcacgggctggcgatggccgaagcggtctacggcgcgctgctcgacgccggctggtcccgttcacgggccacccacatcggcgcgctgatgcgatatctgatcaccgggtcggcgctcggctccttcgcgatgggcttcgcggtcgacccggcgctctacgaccactatccgcacctgcaccgcgcccacgagctggcggcccaccgcgcggtggtcgacgagggcgctttcgaactcgggctggacgtgctcatcgccggcctgtccgaccactacgaccagggagtacgccgatgacgtcggaattccgggaacagctctacatcggcggtgcctgggtgccgccggcggcgggcgaccggatcgaggtggagaacccgtacaccgagcaggtgatcgggcacgtcccggccggcaccgccgcggacgtggacctcgcggtcgccgccgcccgccgggccttcgacggctgggccgggctgccgatgaccgagcgcggcgccgccctcgaccggctgcaccgggccctcgccgcccgggccggcgagatcgcccgcaccgtcggcctcgaactcggcaccccgctcaagatcgcgcaggcggtccaggccggcctgccgctcaccgtcctgcgggggtacgccgacgcggcgtcccgcccggtcgagccggagacgatcggcaactcgctgatcctgcgcgaggcggccggcgtggtcggcgcgatcaccccgtggaactacccgctgcaccaggtcgtcgcgaaggtcggtgcggccctggcggccggctgcaccgtggtgctcaaacccagcgagctcaccccgctggtggcgtacctgctgttcgacgccgcccacgaggccgggctgccggccggcgtgctcaacctggtcacgggcaccggcccggtggtcggcgcggcgatcgccgggcacccggacgtcgacatgatctcgttcaccggctccaccgcgaccggccgcgcgatcagccacgccgcggccgaccggatcgcgaaggtctcgctggagctcggtggcaagtcggccaacgtgatcctggaggacgccgacctggtcaaggcggtcaaggtcggggtgggcaacgcgttgctgaactccgggcagacgtgcaccgcgtggacccggatgctggtgcaccgcgcgcactacgacgaagcggtggcgctcgccgccaagaccgcggtcggttacgtcaccggcgacccgttcgacccggccacccggctcggtccgctggtctcggcggcgcagaaggaccgcgtacgcggattcatcgaccgtgccgacgcccggctggtggccggcggcccggccgcgccggtgcccggcaccgggcacttcgtggcgccgaccgtcttcgccgacgtcgacccggacagcgagctcgcccaggaggagatcttcggcccggtgctgtcgatcatcccgttcgacagcgacgaccaggccgtggcgatcgccaacaactcgaagtacggcctggccgggggggtctggggcagcgacgagcgggcgctcgcggtggcccggcggatccgcaccggcgccgtcgacgtcaacggcggctcgttcaacccgctcgccccgttcggcggctacaagcagtccggtgtcggccgggaactgggccggttcggcctggaggagttccagcaggtgaaggcggtccagcggtgagccaccacatctccggtctggtcgtgacggcggccggcgccccggcgagcgtcgcggagctgcggcttcccgagatcgggcccggccaggtgcgggtccgggtccgggcggccggggtctgccactccgacctctccatgatcaacggcacgctgcggccgccgcacccgctggtcctcgggcacgaggcggccggcgaggtggtcgaggtcggcgagcacgtcacccgggccgcggtcggcgaccacgtggtgctcaactggcagccgccgtgccggacctgctggttctgcgcgcacgggcagccgtggctgtgcgccacctcctccggggtcgccgccctggagaacgggatcaccctcgacggcgcccccgtgcacgtgtgcctggggctgggtgcgttcgccgagcaggtggtcgccccggagaacgccgtcatccgcgtaccgccgcagttggatttcgaggtcgccgccctcctcgggtgttcggtgctcaccggatccggcgcggtccgcaacaccgcgaacgtgcagcccggcgaatcggtgctggtcatcggcctcggcggggtcggcctgtcggtggtggccgcggcccgggcggccggcgcggcgcaggtcatcgcggtcgacgtgaccgaggcgaagaagggcctggccgaagcggccggcgccaccgacttcgtggtctcctcggacgcgctgtccaaggacatccgggtgcgcaccgagggccgcggtgccgaccacgccatcgaatgcgtcggccgcgcctcgacgatccgcgcggcgtggcgggccacccggcgcggcggccaggtcaccgtggtcggcatgggtgcggccgacgacatggtgcagctcgccgccctggacatcttctcgtcggcgcggaccctgcgggcctccgtgtacggccaggcggacccggacatcgcggtgcccgccctggcgcgcgacgtgctgaacggccggttgtccctcgaccacctgatcaccgaccggatcgggctggccgacgtcccggccgccttcgaccggatggcccgcggcgagggcgcccgctcggtggttcacctctgatgaccggctccgccgggtcgggctcctgacccggcgggccaccgcgtccccggtgcccgcggggcatccgcggctgatccgatccgcgccgtggtaccggaaccggatcggtgggctcggatgtcggataggtgatggagcggggtgggggtcgatgtcatggtgcggcgatgggggagttcactggcgggtccgggctgctcgaacggtccgggcagctcggcgcgctgcatcaggcgtacgactcggtgcgccgcggccgcggcggtgtgctcgtgctgctcggcggagaggccggcggtgggaagaccgcgctggtgcgtcgcttccgggacgaggcgcggcccggccggccggtgctctggggcggctgcgatccgttgtggacaccgcgtccgctcggcccgttcctggagatcgcgcacgacgcagccgacagcggcccggtccgggagctgatcaaccgcggcgcgaaaccgtacgagctggccaccggcctcatcggggacgcccgggagcggcccggactgattctggtcctggaggacctgcactgggccgacgaggccaccctggacgtgctcagcctgctcgggcgccgcatcgacggcatcccggcgctggtcgtcgccacctatcgcgctgacgaggcgggccgcgggcatccgctgcgccggctcctcggcgagctgcagggcgcggcgatccggcggatgggggtgccaccgctgtccccggcggcggtcgaggagctggcccggccgcacgggcgggacgggcgggcgctgcatcgggcgacccgcggcaacccgttcttcgtcaccgaggtgctggctcgcgacgacggcgacgtgccgctgaccgtccgggacgcggtgctggcccgggccgcccggctgagcccggccgcggccgcggtgctcgacgaggtcgcggtcaccccgccgcacaccgagctgcgcctgctcagcgacaccgccggcgtggacgaggcggtgcgggccggcatgctggagtgcgtgccgggcggggtggcgttccgccacgagctggcccggatcaccgtcgaggagtcgctcagcccgcaccgccgcctcgacctgcaccgccgggtgctggccgcgctgctcgccgagccggacgcggccgacccgagccgggtcgcccaccacgccgacgcggccggggacaccgcggtcgtcctggagtgggcgccgcgcgccgccgagcaggccgccgactcgggcgcgcaccgggaggccgccgcccagtactcccgggccctgcgcttcgccgccggcctcggcccgatcgagcgcgccggcctgctggaacgccggtcgtacgagtgctacctgaccgagcagaccgacgagtcgatcgacgccctgcgggaggcgatccggcagcgccggctggccggtgaccgggtcagcgagggcaccgccctgtcccacctgtcccggcggctgtggtgcggcggctacatcgaggaagccgccgacgccggccgggcggcgctgcggctcctcggtgacctgccgtccggcccggagtacgcgatggcctgcaccaaccaggcgtcgatcgcgctgaacatcgaggagtacccggacgcgatcgagctcggcacccgggcgctgcggctcggcgaacggcacggcctgcccgaggtggtggtgcacagcctcaacaacctgggcaccatgcagctgctggccggcgaaccgcaggggatcggcaaactggagcgcagcctggcgctggccgagcaggaacggctggaggaacacatcggccgggcgtacatccacgtcgggtgggcgatgacccgggtccgttcctaccacctgtcgtcgtggctggaccggggtgtcaccgcctgcgccgacctgggcctggaggcgtggaagcactacgtgctcgcctaccgcgcccgctaccacctggacctgggccgctggccggaggcggtcgccgacgccgagcaggtgctgcgcgaggccaaaccggtgccgctgctgcgggtcatcgcgctcagcgtgatcggcctggtgcaggcccgcggcggcgagacggacccgtggccggtcctggacgaggcccggtcgctggccgcgaccagacccgagttgcagtacgtcgcaccggtcgccaccgcccgcgccgaagccgcctggccggccggcgccccggtcgaaccggagctcgcggaaacctgggagctggcccagcgccggcgcgcggtctgggtcctcggcgaactcgcctggctgcgccacctggccggcgagccgcaccccgagccgcccgccgcgcccctcgtcgaaccttacgcgttgcagctagccggtcacatcgaggcggccacggagcgatggcggaagcgcgactgcgcgtacgacgcggctctggccctgtccggcgcccccgccgaaacctcgctgcgcgccgccctcgccgagttccagcggctcggcgcccgccccgccgcggcggtcgtcacgcgccggctgcgcgcccgcggcatccgcgacatcccgcgcggcccgcaacgctggacccgcggcaacccggccgagctcacccggcgtgaggtcgaggtgctcggtctggtgcagcaggggctgtccaacgtggagatcgccgagcggttgttcctgtccaccaagacggtccaccaccacgtctcggccatcctgcgcaagctcggcgtcgcccgccgcggccaggccgccgccgaagcgtcccggctgggcctcaccccggcagattgatccggcgctctctcgccgcgcacggtccgcggaggcgtcgatgccgcgcacggtccggggaggcgtcgatgccgcgcacggtccggggaggcgccgatgccgtgcacggtccggggaggcgtcgctgccgcgtacgcggcgccaccggctcgtcggtggccggcccggagtgacccgggccggccaccgacgcactaccgcgggccgccgctcagcagcgagcgcaggctgcgggcgagggcggccgtggcggcctcaaccggcagttccatcgcctcccgccaggtggcccaggccggccacaggctgatcgcggtcagcgcgttgagcaggtcctcgtcggtgccgatctcggccgggaaggcgtcggtcagctcgtcgcggacccgggccacgtgcagccgccggtagcgctgcagggcgctggagaacggctccttgagcgcggacgcccgcgcggccgggccgatctcctccagcatccgggcccgctgccggcagaacgcgtcgatccgctcggccagcggcagatcggacgggatcttccggtacgacgcgtcgcgctgctccaggacccgctgaccgctggccgccatcagcgcttccatgtcggcgaaatggctccacagggcgcgcagcgagacgccggccagtttggcgatccgatccgcggtggggcgcaggtccccgtcgcggatcagctggaggtgggcgtcgacgatcgcgttgcgggtccgttcggaccgggcggtgcggccgtcgacgcgcggcggtgtggtcacggacgactccggtagcggttcaactcccgccgggccagcgagcgcttgtgcacctcgtcggggccgtcggcgagacgcagcgtgcgagccgccacccagagctgggcgagcggcgtgtcctggctggtgccgaccgcgccgtgggcctggatcgccttgtccaggatccattcgacggcctgcggtacgacgatcttgatggcctggatctcggtgtgcgcgcccctgttgccgaccgtgtccatcagccaggcggccttgagcaccagcagccgggcctgctcgatccggacccgggactcggcgatccagtcctgcaccacgccctgctcggccagcggcttgccgaacggggtgcgggtcagcgcccgcctgcacatcagctcgagggcccgctcggccatcccgatcagccgcatgcagtggtggatccggccggggccgagccgggcctgggagatcgcgaagccgccgccctcgacgccgatcaggttgcccgccggcacccggacgttgtcgaagatcagctcggcgtggccgccgtggtcgccgtcggtgtaaccgaagaccgtcatgccgcggtgcacggtgaggcccggggtgtcccggggcaccaggatctggctctgctgcacgtgccggtcggcgtccgggtcggtcttgcccatcacgatgaagatcctgcagttcgggttcatcgcgccggtgatgtagaacttgcggccgttgatgacgtactcgtcgccgtcccgctcgatccgggtgccgatgttggtggcgtccgaggaggccacctgcggctcggtcatcgcgaacgccgaccggatctcaccggccagcagcggcttgagccagcgttcctgctgctcgggggtgccgaactcggcgagcacctccatgttgccggtgtccggtgcggcgcagttcagggcggccggggcgatcgccgggctgcggccggtgatctcggcgagtggcgcgtactgcaggttggtcaggccggcgccgtgctcaccgggcaggaacaggttccacaggccggcctctttcgccttggcctgcagaaccttcagcgcggccggtggctcccagccgtccccgccggcgtggtaaccggcctcggccgggtacacgtgctcgtccatgaaggcgagcagccgcttgcggtagtcctcggtcgtcgcgtcgaactcgaagtccatcagttcccctccagcgctcggtgaccctgctcgatcagcgtgggcaccatcgcgccgacggtgtcgaaaccggcgccgacggtctggcccttggtgaatcggtagtgcacgccctccaggatgacggcgagcttgaacgccgcgaacccgacgtaccagtgcaggtcgccgacgtcgcggccgctgcgctcggcgtaccgcgccgacatctccgccagcgacgggtgcccgggcaggtcgatcggcgcgtacggcttcccgtccttgaccagcagcggccggccggcgtagaccagcatcagggcgaggtcgctgagcgggtcgccgagcgtcgacatctcccagtcgagcaccgcgttgacccgcaggtcgtcgccgatcagcacgttgtcgaggcggtagtcgccgtgcaccacggcgcccgggccgccggccgggatgtccgccgccagccgggcgtgcagctcgtcgatgccggacagctcccggctgcgggacgcgtccagctgctgcttccagcgccgcacctgccgcgcgttgaagccctccggccggccgaagtcacccagcccgatcttctccgggtccagcgcgtgcaggtcggcgagcgtgtcgaccagggtgagggtcagctgccgcagatccaccccggtgaactgcgcggcgtcccggtagatcgtgccgtcgacctgctgcatcaggtagaacggcgccccgatcacctcaggatcggtgcagagcagcaccggcgccggcaccgggaagcccgcctgcgagagcgcggccagcacccggtgctcgcgagccatgtcgtgcgcggtcggcagcacgtgcccgagcggcgggcggcgcagcacccaccggtgcgttccgtcggtcaccgcgtacgtcagattcgaccggccgcccgcgaacatcgtcccggtcagcggcggactgtccagatagctctggagcttcgccagatccaggcccttcatcaggcacccgcctcgaagccgcgctgcatcctgttcatgccgcccagccaacggtccggatcggtcgcgcgcaagcggtagtagtcggcgacctccggatgcggcaggatcaggaaccgattgtcggtgaggccctcggcgaccacgccggccaccgcggacggctccagcgcgccctcggcgagcagcgccgcgctgccactgccccgggcgttcccgccggtcagcatgtcggtgcggaccccctgcgggcagagcgcctggacgatcagaccccgatgggcgtacgtggcgcgcagccactcggcataggccagcgccgcgtgcttggtcacggagtaggacgcgctgcccaacagggtcagcaggccggccgcgctcaccgtgatcagcagccgtttcggctcgtccgtgtccagccaccggggcagcagcgcgcgggtcacgtgaacgtgcgacttcacgttcaccgcgaagtcccgttcccacagctcgtccggagtgttctcgtccccggccgtgaggacgccggcgttcgagcagaacaggtcgatgccgcccagctcgtcgtaggcacggtcgatcagaccgcgtacgtccgcttcgatcgccgcgtcggccgcgaccgcgacggcgccgatctcccgggccaccgcggacgccgcgtccgggttgatgtcgctgacgacgacccggtcgccgtcggcggcgaaccggcgggccagcgcggcgccgatcccgccaccggcgccggtgatcacgacgcgcttcactcgaccaccccggtcagggtgacgccgccgtccagcacgatggtctgcccggtgatccaggacgcgtcgttcgagcagaggaacgccaccgtgccggccacgtcctcgggcgcacccagccgcttcagcgggtacgtcgcggtgacctgctcctcgcgcccctcgaacagggccgcggcgaaccgggtcttgaccaccgccggcgccaccgcgttcacccggatcctcggtgccagctcgacggccagctcctcggtgaggtggatcagcgcggccttggtggtgccgtagaaggcgatgccgggcgccgggcgcaccccggagaccgacgagatgttgacgatcgacccgccctcgctctgcccgaggccgccgcgcaacgcctcctgcacccagcccagcgtgccgatcaggttgacctcggccatcttgcgggcggcgttgagatccagggcggcgagcggcccgtacgcagggttgatcccgatgttgttgaccagcgtggtgaccggcccgaacgtcgcggtgaccgcgtcgaccaccgcggtccggtggtccgcgtcgtcgcccttgccgctgatcccgagcgccaccgccgggccgcccagctccttgaccgcggcctgcagggcgtcgtcgtcacgtccggtgatcacgaccttcgcgccctgcgccacgaatcgttgcgcgatggcgaacccgattccccggcttgccccggtcacgatcgccacttggtccgccatcgcactacctcctcagattttctgcactcagtgtgcggatattacgccgccgggatcccgttcggtggcggtgtcacggtgagaggggccaccggctgcaccgcgccgtccgcgtcatccgtggtgtaggcctgcccgaggaacaccgccttgccgccttcgatccgggtgagctgctctccgccgtatcccgagtgatccttgtcggcgaagcgcagcgggaccaggcccggaccctggaaaccgttcttcgtgaccgcggcgaggatcccgtcgcgggtcagattcttgccggcggccagcagcgactgcacgaagaggtaggccgcggccatcccgtacacgacgttgttgtcgaattccgcgttgccgttgtactgcgcgttgaccttcttgaagagctggatccacgggctggcgtcatcggtgttgatcggcaggtagttggccgagaccacgccctccagcagcggcgcggcggggcccagcgccttgccgacggtgcccgggtcggcgcccacgttgctgaccacgaactgcggcttgaagccgatcttcgcggcggtgccgaccgccagtgcggtgaagcccgggatggtggccagcacgaccacctcgcagccggcctgcttgagcgcgcccatctgcgggccgacgttcgggttgctggtcacgtacgtctgcttggcggccaccgcgcccaggaccttctcgacgccggccaggctgtcccggccgaagtcgtcgtcctgacccaggaagcagaccttcttgccggccaggttctgcttgacgtaggtgccgaggatcttgccttcgacggtgtagtccgggttgaagccgaacgtgcccggatacttgtccggctggttccagctgcggctgccgctggccacgaagaggtccggcacccggttggtcttcaggaagtccagcacgccggaatgcgtcggggtgcccaggccgcccatgatcgcgaagaccttgtcctgcaacaccagttcccgcaccacctgctgggtggtcgccgggttgtagccgtcgtccttgaccttgtaggtgatcttccggccgttgaccccgccggccgcgttcacgaagtcgaagtaggccttggaggcgggcgcgatcttggagtagccggctgccgcggggccggtcagcggcatgtgcgtgccgatcaccacctccgagtcggtcaccccgggcacggtgccgccgccgctgcccgacctggtggacgacccgtcacaggccgtggcgaacaagaggacggcgaggaacaccgccgtggtgcgtttcatcgtttcctcctgaatatcgtggaaaatcgcagggatgcgaggccgcccggggcggcgagcatgacgacgacgagcaccacgccgaagatcaccagggccaggttgccctccagatgctgcgagcccgagctctcggcggcgctctgcgccagcgccggcagcaggaccagcagcaccgcgccgagcagcgccccgatcagccgccccagcccgccgatcacgatggccatcaccaggaacagcgacagggtcagcgggaacgcgccgggggagacgctctgcgcgaggtaggcgaacagggcgccggacagaccggcgcaggcggcgctcaccacaaaggcgatcacctgggtacgggcgatgtgcaccccggcgagccgcgccgcggtctcgtcgtcccgcaccgcccgcagatcccgcccgaaccggccgcgcaccaacgtcgccagcagggcagcggtcaacagcgcgccggcccagcagagccaggcctgccactgctccatcgggatcacctccggcggcgggtcgagtgccaccggcaggccctgatcgctgttgaacgtcgtgtcgaaggtgctggtcaccgacgggaccacgacggcgaccgccagggtgaggccggccaggtacgggccgcgcaggcgggcggcggccagcccgatcaccgtgccggccagggtggtgaccaggaccgcggccaggaaactcaggggcaggtgcagccacctgttctgggtgagcgcgaacgtgtaggcgccggtggccatcagggcgccgtgtcccagcgacagctgaccgttgagtccggtgaggacggtcaggccggcggtcaccgtgaagtacgcgccgacggtggccagctggtagttgcggaacggcggcaggacgtaggtgagcgccaggatgatcagggcgccggtcacggcgtaccccagcgggggtatgcgccgggtgacccggatgggggcggtggcggtagccggcttctcccgcacgtcggtcatgccagcctcgccttcgcactcgagaacaggccgccgggacggcccagcagaacgaccacgagcagcagcaacaccgccatcggggcgaccgtcgcgcccagatatccgctgacgtaggacagcagcaggcccacgatcaggccgccggtgaccgcgccgatcgggctgtccagaccgccgaccacggccgcggtgaacgccgagacgaagacgacgtccatcgcggtcgggtgcagccccagctcggtcgggacgaccagcatcccggccagcgacccggccgccgcggccagcgcccagcccagcgtcaacatgccgccgaccgggacgccgagcagccgggagacgtccggggcgaacgcggcggcccgcatccgtagaccgaccggggtgcgggtgaacaggatcgtcagcccggccaccacggcgccgaccgccacgaagacgaacacgtcgtagcggctgagcagggccaccccgccgacctcgaacgcgtcccggcgaaacggcgtcggcaccgggcggaactcgttgccgtagagcatgccgagcgcgccctgcacgatcaggaccaggccgagcgcgaccaccaccccgttgagcggcgacgcatggtcgacgaaacgcatcaccgccttctccaccgcgacacccagcagcaggccgaaaagcagcgcggcggcgaaacccagccagtaggagccggtcgcgtccgtcaccgaatacgccacgtagaccgcggcgacggccatcgcgccctgcgcgaagttgacgatccgggcggcccgccagatcagcaccagggccagcgcgaacgcggcgtagaccgcgccccggctcagcccgtcgaatgtcaggtagatgaatctgtccacgtcagaaccccaggtaggcgtgtcggaggtcggcgtcgtcccgcagctcggtggcccggtttcgggtcgccacccggcccagcgagagcacgatcccctcgtcggcgatcgacagggcgctgcgcacgttctgctcgaccagcagcaccgccagtccggtccggtcccgcagatcccgcagcagcgccatgatctgcgcggtcaccttcggcgccaggcccagcgacggctcgtcgagcagcagcagccggggccggccgatcagcgcccggcccagcgccagcatctgccgctccccgccggacagttgatgcccggcgctggcacgccgttgggccagcgccgggaagaggccgtagacctcgtccagggcgcgtgccgcatccgcgcggtcgcgccgccacaacccgcccagccgcaggttctcctcgacggtcagctcggtgaccacaccacggccctccggcacgtgcgcgatgccgcgccggaccatctgctccacccgcacgccggccaggtcctcgccgtcgaagacgaccgacccgcggtccgcccggaccaggccggacaacgtccgcagcagcgtcgtcttgcccgcgccgttcgccccgagcacggcgacgatctctccggcccgcacccgcagccgcacgtcgtgcagcaccggcgccgcgccgtaccccgcggtcagcccgtccacccgcagcagcgtccgctgcttctgataccgctcgtccagcgtcccggcggcgctcacgcggcggcacccagataggcctcggtgacccgctcgtccgcactgatctcggccggcgagccgagcgcgatcggcttgccgaagtcgagcaccaggatctcgtcgcagaccgacatgaccaggtccatgtgatgctcgaccagcagcaccgtggtcccgacgtcccggatcagcccggccagccactggatctcatcggtgtccagaccgccggccggttcgtcgagcatcaggatccgcggtcgggcggcgagtgcccgggccagctcgatccgcttgcggatcgcgtagggcagcgccccgggaagctgatccgcatacggggccaccccgcaccgctccagcgccgcgaacgcctcccgcacggaccgccgctcccacccgccgaagcgccccccgcggccgagccggcccccctcgcccccgcgcccgcgatccggctcccgcatcagccggcccgatccccccgtgtgcccgggatccggctcctgcgtgagccggcccggtccctccgcgcgcccgcggtccgggccctgcgtgagccggcccggtccctccgcgcgcccgcggtccggtctctccgggcggtggccgcgcgctccgacctgcacgttttcgagcacggtcaggccgctgaactggcccaccccctgcagcgtccgggcgatgcccagccggttgaggtggtgcggccgcggccgccaggcccgcccgtccaacgcgagggccccggccgtcggcgtgacgaacccgcagatgacgttgaagagtgtggtcttccccgccccgttcggcccgatcaccccgaccacccgccccgccggcacccgcagcgagacgtcgtcgagagcggtcagcccgccgaagcgcacggttatgtggtcgagctccaactcggcatgcgtcgacatggccacctcatccggaccacaaaggtccacaatggaaagtgatggtcaactatttacactaggagtgtaactttatgatcgggttcgtcaaccagttgcaacatctccgttaccggatgccaccccggcgtccgtgatcagcccgaactgattgccggcgatcgctactctgcagggaagcccgccgatccgtgaggtgcccgatgacgcagccgccaccccgcccggaggatcgggacccggccaccccggcctcgccccgccccaccccaccgcccacggatccgctcaccgcgaacctcatcccgcccgtcgacccctggcccgccgccgccccgccccaggagccctatccgccggccgcgcctctgggcggctatccgccggcatcagcgcagggcggctacccgccggcatcagcgcagggcggctacccgccggtcccgccccaggtggcccacccgcaggccgcgcccggggaggcccacccgtcggcggcgtatccggcggcgtatcaagcggcccatccggcggcgtcgcagccggcccatccgccgccgccctaccgatacccggcggctttcggcggtccggcgcaggtcaagtcactgcgcgtgccggcggtgatggccaccgtcggcctgatcctgacgattctctacatcgtcatcctgtacaccgcggacccggtctcgatcaccctcggcgacgccccgcggctcgtcctgtatgtcggcatcttcgccacggtgatctacaccgtcgtcacgttcctggtctggctgcaccgcgcctcggccaacctttggaacaccggccaccagctcacatggggccccggttggacgatcggcgcctggtgcatcccgatcgccaacctgatcatcccaatgatgatcatccgtgaggtcgaccgtgagtcccgcgatcacggccccggtctcttcgccgcctacgccgtcagctggaccgtcagcgtcctgctggaacgcagctcacgcacggcctccagcggcaacacggtccatgtcgtggaaaccgtcgcgaccatcgccgccgcgatcacggccatcctcctcatccgccgggtcaccgccgaccaggagcagaggttccggactgtctgaccccatcacgccacccctcgtggccgaaactgcacactgatccgggggcccaccggccgagccgtcttcggaatcgcgtgctcccaggtccgctggcaggacccgcccatcacgatcagatcgccgtgcccgagcgggaaccgcaacgtctcccgctcgccggcccgcggccgcagcaccagatttcgcggcgaacccaccgacacgatcgccaccatcgtgtcctcggtcgccgaccgcccgatggtgtccccgtgccaggccacactgtcccgcccgtcccggtagaggcacatcccggcggtcacgaactcctccccgagctcggtcgcatagtgggcgttcagtgccgcccgggcggcggccagcgccggatgcggcagcggctcacccgcgccgaaccagcgcagcagccgagggacgtcgacgacatcgtcatacatccggcggcgctcggcccgccagtcgatgcccagcagcgtctcgaacaccgcgtccgacccgtgcagccacccgggcagcacgtcgacccacgccccggcgctgagacgatgccggaccgccccgctcagcggctccagcgacggctccgccgaccccatcagatcgagcatcgaaggctgatatgcgctgctcatgccgccatgttagtactgacgttcgatcgcctgtcaggccctgtggacaacttcgccgctacaccggcacagccgctgacaggacggttcagccctgtcggccccgacccccgctggtcatcgcgcgggacacgggcccgcaggtcgcgagaggccggctcgtcggaccggcgatccgtcgctcagtcggtggcgaggcgagcatgctggtgcatgtcgtgccaaccgtcggcgtgccgcgcctcggaccgcttgatcccctcggccggatagccggcctgctcggcgacccggcaggaggcggcgttggccgtcgagtggttcagctccagtcgatgcagccccaggccaccgaaggcccagtcggtcaacgcgtgcaaagcccgcggtgcgatgcggcgcccccggaacgccggcagcacccagtaggagatgtgcgccgttgcctcggctagatcgatccgtcgcagcccgatctgaccggccacccgatcgtcgtcgacgatcgcccagcttgccccggtttctgcctgccagcgtccggcccatccggcgatccacgcctccgcctcagccggggtcatggagtcgcagtgccaccgttggatcgccggatccgcatacgccgtgaccacggagtcccgatcggcctcccgccagacccgcaacgccaccccgtccccgccgatcatcggctggtcccgttcggacatcgagccggcgggcagtgcgggtgtgacaagcgacggcatgcaccgactctatgcggtacctcccaccgcacatcctcacgatggcgggcagagcggcccgcgggaggcgccgcccgggccgggcggcgcggccgggtcgcgggatgtcgcggccccgcggcgtaccccctaatcgggttttgccgggtcttcctccggatggtggtaggtgacccgctccagcggcagcggaaacgtcatgtcctcgccgaacggggagagcccgccctgcagcggcgccgcgagttcggcgatctccaggcgtccgtcgacgccgaccggcgggccctcggggaggcgctggccggacggggtctcggcggtggccggggcgcggcgcggtgcgggcaggggtgatccggcggtggcctccagctggtcgcggcggaagattctgcggccgaggcggaccagcgggtcgtagcggcggtccacgactcgctccttcatcgggatgatggcgttgtcggtgatcttgatgtgttccgggcagacctcggtgcagcacttggtgatgttgcagaagcccaggccctggctctgctgcgcatactgcttacggtcggtgcggtcgtccagtggatgcatgtccagttcggcggcgcggatgaagaaccgggggccggagaaggcctccttgttctcctcgtggtcgcggaccacgtggcaggtgttctggcagaggtagcactcgatgcacttgcggaattcctggctgcgttccacgtcgatctgctgcatccggtactgcccgggggcgacgccggccggtggggcgaacgccggggtctcgcgcgctttcgcgtagttgaacgagacgtcggtgaccaggtcccggatcaccgggaaggtccgcagcggggtgaccgtgatcatctcgtcggcggtgaaggtggacatccgggtcatgcagcccagtcgcggcatgccgttgatctccatcgagcaggagccgcacttgccggccttgcagttccaccggcaggccaggtcgggcgcctgggtggcctgcagccggtggatgatgtcgagcaccacctcgccgtcgttcacctcgacgtcgaagtcctccaggtcgccgccggacgagtcgccccgccagacgcggaagtgtcggttcactcgtcccccagctcctcgtcggtcatgtatttggcgagctcactgcgctcgaacaggtcccgcagctcggggcgcatggtgggcaccggcttgcgttccaggtgcacctcgccggcctcgtcgagcgagcagaccaggttgatccggcgccactgcgcgctcatctgcgggtggtcctcgcgggtgtggccgccgcgcgactcctcgcgttccagtgccgccttggccgtgcactccgagacgatgagcatgttgcgcaggtcgagggccaggtgccagccggggttgtagtgccgcccgccgcctcccgcgcccacgttcgccacccgggcgcgcagctcgtgcaggcgtttgagcgcctcggtcagctcgccctcgcggcggatgatgccgaccaggtcacccatcaccgcctgcaggtcctgctgcagtcggtacgggttctccccgtcggtgcggaccagcggggcgagcgccacctcggtggctgcggccacgtcgacccgggccggccggggccgcttggccagcgtgtccacataggccgccgcgtgctcaccggcgcgtttgccgaagaccagcaggtcggagagggagttgccgccgagccggttggagccgtgcatgccgccggacacctcgccggccgcgaacagcccgagcacggtgccggccgcggccccggtgtccgggtccacctcgaccccgcccatcacgtagtggcaggtcggcccgacctccatcggctccttggtgatgtcgacgtcggccagctccttgaactggtggtgcatcgacggcaaccgcttgatgatctgctcggccggcagccgggtggagacgtccaggaagacaccgccggccgggctgccgcggcccgccttgacctcgctgttgatcgcccgggcgacctcgtcgcggggcagcagctcgggtggccggcggttgttgtccgggtcgtcgtaccaccggtcggcctcgtcctcggtctccgcgtactgcttgcggaagacgtcggggacgtagtcgaacatgaaccgcttgccctcggagttgcgcagcaccccgccgtcgccgcggaccgactcggtgaccaggatgcctttcacgctcggcggccacaccatgccggtcgggtggaactgcagaaactccatgttgatcagggtggcgccggcccgcagggcgagggcgtggccgtcgccggtgtactcccaggagttcgaggtgaccttgtagctgcggccgacaccgccggtggcgagcaccaccgcgggcgcctcgaacagcagcagatcgccggagtcgcggtagtagccgaacgcgccggcgacccggtcgccgtcgagcagcagctcggtgatcgtggtctcctggaacacccggatccgggagtcgtagctgccggtctcggcgaagtcctcctgctgcagggagacgatcttctgttgcagggtgcggatcagctccaggccggtgcggtcgccgacgtgggcgagccggggatactcgtgaccgccgaagttgcgctgcgagatcctgccgtccttggtgcgatcgaagagcgcgccgtacgtctccagctcccagatccgctccggcgcctccttggcgtgcagctcggccatccggaagttgttcaggaacttgccgccgcgcatggtgtcccggaagtgcaccatccagttgtcccggctgttcacgttgcccatcgcggccgcggcgccgccctcggccatcaccgtgtgcgccttgccgaacagcgacttggagatgatcgcggtccgcttgccggccagccgggcctcgatcgcggcgcgcaggccggcaccgccggcgccgatcaccacgacgtcgtacagatggcgttcgggggtggtggtcatcgtcgacgcctcctagccgatcagccgcaggtcggagaaccagccggcggagaccgccatgatgtagaaatcggtcaccgccagggtgccgagggtgatccaggcgagctgcatgtgccgggcgttgagcttggacacggtcgtccacagtcgatagcgcaccgggtgtctggagaagtgcttgagccggccgccgacgatgtgccggcaggaatggcaggaggcggtgtacgcccagagcatgatcacgttgacccagaggaccagattgcccaggccgaggccggtggtctgggcccggatcgcgtcccaggtgttgatgatcgagatcaggaacgcggcgtagaacgcgtaccggtgcgcgttctggaagaccagcgggaaccgggtctcgccggagtacgtcttgtgcccgtccggcaccgcgcaggccggcggtgacatccagaaggcgcggtagtacgccttccggtagtagtagcaggtgagccggaagagcagcaggaacggcagggtgagggccgcctccgggatcagccagaagctcggcaggggagtgccgaactcggccgcggccccgcaccggtcggtcaggcagggggagtagaacggggtcaggtagtgatactcgtcgacgtagaaccagcggtgcaggaagacccggaccgtcgcatacgccacccaggcggtcagcccgaggaacgtgaccagtggcgccagccaccagcggtcggtccgaagtgtccgggccgtgatcgccgcgcgtgcgcgcccgccgcccggcctcgctgccgtcgtcgtcatgcatccccctgccggtgccgcgtcagctgcgcgggccgtccggaagcggacacacgggtgcccgccgtcagccgtcctcgcgcgacggtgatgtggagcacacgttacgccgaaggtccgacactttgcggaccggggatgccaagtgggtcacaaaaacatcatcccggtccgcaaagacggtcaccgatgggttactggatcatcccgacgcgttgccggtgacgttccacgacgccaggtgcagggccggcgacgcataccgcgcgtcaccccaggaggtgggcaacagcaccgactcggcgccgatgcccagcacccggcccggccccagcgcctgcgggtaggactgggtgaagcgcaggttgctcaccgggcgggtgatctcgccgtcctccaccagccacacgccgttgcgggtcaggccggtcaccaccagcgttttcgggtccagtacccgggtgtaccacaggtcggtgaccagcaggccgcgacgcatccgggcgaccagcgggcgggccgacacggccacctgcgggggaccgtccggtgtgccgccgcccccgggcagcgccgcctccagccgcaggtgcgccgggaacggcccccacgaccgggaggtccccgacgcgtgcccggtcgactcggcgccggcctcggccgcggacgtccggtcgtgggccaccgccagggtgatcccctcgcggaccagcaccaccgagcgggccggggtgccctcgtcgtcgaagggcaggccgggggccggctcgccgcggctgcccagcgggtcgtccacgatggtcaccgaggggtcgaactgctcggcgccgaactcggcgaacgactgccgctgcgcatacgacttcccgttgaacccgaagaccgccagattctccagcaggtcggcggtggcggtgggctccagcaccacctcgtactgcccgggcgggagctcggccggctcggcgagcgcgcgggccttggccgtggcccgggcgccgagcgccgcgccgtccagatcactcagccgggcggccgccagccgggcgacgccgtcggccccgttgttgcgcgcgatgccgtccatcgccgcctccgcggtgcgcccctcgaccgcctgcccggcggtgttggcgaacgcggccgacacgtactgcgtgcggcagaagccggccgtctccagcccgccggccgcgtcgacgaaggcccgcacccgctcggcccgttccgccggggtggcccgggcggtcgcctcgtcgaagccgaactccagcccggagtgctccccggagcccgggtggccggccgagatgtgcagcgccgcgggccgggtcagcccggcccagcccgggtcgggcggggtcacccgggccgccgccacggtccgctcgaccagcgcccgcaacccgtccgcgccggtcagggtggtcgagccggacgccgtccggccgtccaggtgcagccgcaggcgcaccccggtggtggtctcggccacgttctggtggatcgccgagttggcgaaccgggtcagcgccagggcgtggtgccggacgttgacctcggcctcggccgaccggccggcgagctcccggaccagctcgacgaccttggcggcgatctgcaactccgaactcatccgcgcacccccacccgcacgttggtgaaccgggccggcgccgccgggtgtccggtgtgcccgatctggccgggctggcccttgccgcagttcggcgtgccccaggcgacgatctcggaggacagcatgtccatcgactgccagaaccgggggccgatcccggtgtaggtcgggttgcgcagcatccgaccccgccgcccgttcttgatctcgtagccgatctcgcagccgaactggaagttcagtcggcggtcgtcgatcgaccaggaccggttgacgtccatgaacacgccgtcgtcggtggccgcgatgatctcgtcgagggtgtgcgggccgggctccaggccgacgttggtcatccggaccatcggcagccgggcccagccgtcggagcggacactgccggcgtagtccagcccggcgaccgccgccgagtcgcgcccggcgagcacgccgacccagacgccgtcgcggaccgcgtgccgtttgaccgccggggtgccctcgtcgtcgaagccgaaactgcccagcgagcccgggaaggtggggtcgatggtgatgttcatcaggtccgatccgtaccgcagctcgccgagccggctcagatccagccagctggtgccggcgaaggcggcctcccagccgaggatccggtccagctcgatggcgtgccccaccgactcgtggatctgcagggcgagctgcgagccgccgaggatcagggtggtctcgccggccgggcagagcggggcggtgagcagctcgcgggcctcctgggccagccgcggcgcgttgcccgccagatccagctcctcgatcagctcccagccgcgcgtgccgtactgcccgggcagcgagcggcgctggacctcgccgtcgccgatggcgtgcgcggtcaccccgccgccgcactcgcggatgtgctggtcgatacggtggccctcgctggagacgaaccacttgcgggtgtcccagatcgcgtagttcgcctgggcctggtcggcgcccgccgccttggccgcggcggtggcccggaccagcaggtcgcccttgtcggccagcggcaccgacagcgggtcgatccggcagtcgctggcccagctcgcggtgaccgcggcggccggcatcagctcgaccggcgctagctagctagtcggagagatcgggaacggcggagaagccccaactcgagccgaccagggcacgcacgcccaggccggcgttctcgtcggaggagaggtcctcgacggcgccgttgcgggccgtcatcgactcggtgcggcagaccatgacacgggcgtccgcatagcgggcgccggcgtcgagcgcggcttgcaccgccgcgcccgcctcatcgaagtggctcatgcccccgaccctaggccgcgggtgcgacaaaaccggtcaggtgcccagttcccgctggatccaggcgagttcgtcggccagcccgaggccggcgtcggccaccagcaccgcaccggccccggccatctcgtcgcgcaggtcgtggtgccggtagacgtgcgccgcgtcgttcgggtcgcccagataccgctcggcgatcggccggggcgccgccgtccagtccagcaccggctcccgggccgccgcgcagcggaccgtcccgggcaggcgcagcgcggccagcagcgccacccacccgcccagccggtgcccgcgggccgcgacccgggtcaggtccaggtcgggatgtttgccggtgagcgcgcccagcccgtcggccaggtcggcgaggatcaggtcggccagccgccggtggatcgccttctcgaagctgggggccacccccggcgtcccccggtagtcgatgctgaccacggcgaagccggcgtcggcccaccactgccgttcctgccaggcggccgcctcggcgcgcacctgctgctcgcccggcccggcgcccaggtcgagcaggaccggcaggctgccgccgacgaaaccgcccggatagagcacggccgtcggcagccgccggtcggtgacccgttcgaggaccggctccgggtggtagggcagctcggcggcgagcgaccgcagggtcccggccggggtcgtcccctgccacacccggccgccggcgaccagcacgtccccgccggtgaccacctcgccgccggccggggccagccgggtcacctccggtccgccgccgcccaccgaggtgcgcacccggaacacctcgcggaccgcggggtcgcccagactgccctcgacgatcaggtccggcgcgccggccgggccgtccgggcggggcagggtaccggccacccggcggacgtacaggccgggcggggtgagcaggctgccgtcggcgaacaggcagcgcgcgtcgaagccgtcgtgcgccagttcgccgccgaccagcacccggccgtccggcaggtgccggggcgtgcccgggatcggctccacccagcgggcgtcggcgagttcggcgtgcacctgggtctccccggtgcgcgggtcgaccgagagcaccaggccgtgctgctgcatccggcgcagcacggtgatcagcgggccgccgccggcccagcggacctgggccaggtgcgggtaggtctcccggtcccagtgcacgtccacccagccgtcgtccaggtcgagcaggtgcaggctggtcccgccggcggtgcgcacggccagcacctggcggccgtccggcgaccaccaccagccccgggtccggccgaactggggcgcgccggccccggccaccccccaggcgatgctgccgccgtgctcgcgccacgcgaagccctgctccccggcgagcagccggtcgccgtccgggccggtgacccgcagcgtggccgaccccagcggatcggtgacgtagccgatccgcacgccctgcgggtcgggccgcgggtcgtacaccgcctcggtggtctgcagcgcggtcaccgcgccggtcgtcaggtcggcgcggtagagccggccgccgcgggcgaaggccgccacccgggcgtcgcgatcgatcgcgtacgcgtcgatcggccccggcgccaccagccgttccgtggtgtcggccaggtccagcgcccagagcgcggccgccggatccgcggggccgggcgagcgcaggaagacgatccgcgccccgtcggcgccgaccgtgacggcgtgcggggcgccgtggcggaagccaccggtgcgcccggcgagtccggggtagtccacgcccctcagcatcgctgatcaaggcgggctcgcgccggtgaacggtgggctcgccgggcgaacctgtcggtggtcgcgcgtacagtatcggccgtgatcgcacgtgattcgctgcccgcgcgccgcctgctgctggtgcacgcccaccccgacgacgaggtgatcgggaccggcgccaccatggcccactacgcctccaccggtgcccacgtgacgctggtgacctgcaccctcggcgaggagggcgagatccacgtcccggagctggcccaactggccgccggtcaggccgaccagctcggcggttggcgcctggtcgagtgggagcgggcctgcgacgcgctcggtgtcgccgaccgccggatgctcggcggccccgggcggtatcgggactccgggatgatgggtctggcgaccaacggtcatccgcgcgcgttctggggcgccgacctggacgaggccgcggcgcacctggtcgaggtgatgcgggagatccggccccaggtcatgatcacttatgacgagaacggcttctacggtcaccccgaccacatccaggcgcaccgggtcgcgatgcgcgccgccgagctggccggcgccgacggcccggcgaagatctactggacggcccagccgctgagcgtgctgcgcgacggcatggaggcgttccgcgagtcggagagcaatccgttcgccgacgtggacagtgtcgaggatctgccgttcggcacgccggacgaggagatcgccgcccggatcgacggcaccgagcactacgcccgcaagaccgccgcgatgcgcgcccacgccacccagatcccggacaactcctggctgtacgggatggccggcgacttcggcggcgagttcatgggtgtggagtactacacgctggtcaagggcgagcggggcccgggcgggggcccgcacaggtgggagagcgacctgttcgccggcctcgacgtggccggcgaatgacgctccgggtcaccggcgtcgtcgtctcggtcgccgccaccctggtcgtcaccgtgatcgagctggtgctcagcgtgctccgggtcggtggggtgaccgggctgttccacggcgagttcgacgtgtggaccggcaccggccagctgatcgggctcgccatcccggtcaccgtcgcggccaacctggcgctggcctggttcgccgtcaccacggtcgagcggccctgggcgatcggcgtgccgtgggcgctgtggacactgctggtgctcggcgcggccggcacccggaccgccgagggcgactatctgctcggcggggacaactgggtggcactggtgatgatcctggccggcagtctggcgttcgcggtctacgcgtaccggatgatcatgaagccggtgaaggagccggtgcggccggagagcgaaccgactgacagctgactcacagctctcgttgcggatcgcgccgcgcgccatccgcgaagatggccggagatcgagcaccgcgggttcgcccggcgctacgatcccggccacggttcgttttccaggaggactcatgaggcagcagcgctggttccggatcacggtgctggcgatcgccctgttcgcgatcaacgcggtgacccggctcgtcgtccggttcggcgccgacggcacggacaccgcgcagaaccgcggctcgatcgtgatgttcgcggcgctcgcggtcctgctgggcggcctggtcttcgtctggtgccagcgccggcggccgagcgactggctgcccgacgtcggcttcggcgcgctggccggcatgctcctcaccgtcctgctcggcccgttcctgagcggcagtgagccgttcgccaacggcggcggcgacttcttcgcccagatctggctctacagcggctgcgcgatcgccggcgcggtggtcggctactgggtcgccgtgaccctggccagggactaccgctcccgctccctgcaggcgtacagccggcagcgcacggtcaagccgcgccgggtcgtccgccgctgactcaggcggccggcgcctcccgggtcagataggtgtgatgggtgctgaagccgagccggccgtacaacgccaccgcggccgtgttccgctcctccacctgcaggtacgcccgggtcgcgccgcgctgcacggcccactgggcgagcccgcgcaccacgtgccgccccaggccccgccggcgggcggccggcgccgtctgcaccagcgacacgccgagccagcgctccggtccggtgaccgcgccccgggccaccgcgagcagttccccgtcggcgtcccggacgtgggcgaagacccggtccggcacgccgttgaggatccgcagcgcggcctcgggcaaccggcccttgtgctcggccaccatcgcgtaccagtcgtcgccggccgagtcggccagcccgaccggcggcaggccgtcccccgccggggcggccaggatgggcgccagcgccgcggtctgcaccagggtcagcggccggctgccccagccgcgttcgtccagcatcgcggtgaccggggcggccagcggcaacggcgtgttgatcagcgggcgctggccgcggtcggagtaccactgctcgaccgcgtcgatcgcggcctccagcggccggtccgggtcgccgacggcgagcgccgagttggcccggccggtccagttgtccgccgcgcgcagcagccagttgcccagccggccgcggaccggtgccggccacgccgcgtcggcggcgagttccagggcgatcaccgcggcggcgtgcggccgacgggccggcggcacccgcttggcccggtgtacttcgcgcagcgggacgcgcagggttcccttgtcggtggcgagtgtgatctcggtctcggtcaggtcgacgagctcacccagcgcatccgtgtacagcggccgatccccggatacgcctacaatgcgccgtaccaccacccggtgtcccacatcctgctgtcggagcacgtgttacctccttcggcgggaatactaggctctgcatttgtcgtcggcggttcccgcggcgtggcttcgaagggaaagacccgtgacctacatcatcgctgagccctgcgtcgatgttctcgacaaggcatgcatcgaggaatgcccggtcgactgcatctacgagggcaaccggatgctctacatccaccccgatgagtgtgtcgactgcggggcctgtgagccggtctgcccggtggaggccatcttctacgaggacgatgtcccggagcagtggaaggactacaccagcgcgaactacgagttcttcgaggatctcggttcgcccggtggcgcctccaaggtcggcaagatcgacaaggacaccccgttcgtgctggcccagccgccgcgcggggacgcacactgagcgctctggcgtcggctcttccggatttcccctgggacctgctggagccggccaagagccgcgccgccgcccacccgggcggactcgtggatctgtcgatcggcaccccggtcgacccggtcccgcaggtcatccggcaggcgttgaccgacgccgcggacaccccgggctacccgctgaccgccggcacgccgcagttgcgcgccgcgatcgccggctggctggcccgggcctgcggcgcctccggtgagctgggcgtgctgcccaccatcggctccaaggagctggtcgcctggctgcccacgctgctcggcgtgggccccggcgacgcggtggtgatcccgcaggtctgctacccgacctacgaggtgggcgtccggctggccggcgccgaggtgatccgctccgactcgctcaccgcggccggcccgcggcgggtgaaactggtctggatcaactcgccgtccaacccgaccggccgggtcctgcccgtcgaccacctgcgcaaggtggtcgcctgggcccgcgagcgcggtgcggtggtggccagcgacgagtgctaccacgcgctgggctgggagtccgagccggtgtcggtgctggccgacgaggtgaccggcggcgactacaccggtgtgctggccgtccactcgctctccaagcggtccaacctggccggctaccggggcgggttcgtcggcggtgatccggccctggtggccgacctgctcgcggtgcgcaagcacgccggcatgattccgccggccccggtgcaggccgccatggtcgccgcgctcaccgacgaggagcacgtggtcgtccagcgggagcgttacgcggcacgccgggagatcctgcgggccgccctgctcaaggccggtttcgagatcacccattcggaggccgggctctacctgtgggtcacccgcggcgaggactgctggcagaccgtcgaccgcctggccggcctcggcatcctggtcgcgccgggcgcgttctacggcccgtccgccgcccagcatgtgcgggtcgcgctgaccggcaccgacgaacgggtggccacggccgccgaccggctcgccgagggtctctgatggccgagcgcctcccgaccgtcgtcgccaccggcgaggcggtccgggaggtgccaccggagctggccaccgtgcacgttcacacggtggccagaggacgcgaccgcgaagcggtcctgcagcggctcaccgaacggtcggcggccgtggcggtggtcctcgaccggttcgccgccgccatcgaacgccgggagaccgccggcgttcaggtccacccgcagaccaggcggcgcggcgagggcatcgccgagtatcacggcagcatcggcacccaggtgctgatcaccgacttcaccgtcctcggcgacctgctcctccggctcgccggcgaggagctgacctcggtctccgggccgtactggcagctgcgcccgggcagccgggccggagccgaggcccgccgggcggcggtcaccgacgcgctggcccgagccgcggagtacgccgcggccgtcggctcccggatcgaccggctgatcgacatcagcgacgtcccgacggccgagggaacgccgatgatggtcgccggagcccgggccatgagcgagacggccggcctggagttggagccggcgttgcagaccgtgcacgcccgggtccgggtcaccgtcacgatcagcgagccggccctgccgatctgagtgttccgggcacgcggcacgccccggtcggccagactcgaccgcatgcgcaccggcctcgggcatctgctgctgcgggtggcgaatgtgaatccgcgcagcgtgacgacccactcggaccgcgtcctgtaccgctcgatcggcgtcttcatcctgctctacgcggtgtacgccaccctcggcggcgccgcgttcatcgacgccggcagcggctatcggcatccctggttccagtggctggtcggtccgctcgtcgcgatcggtgtggtggcctacgaccgggcggtcgtcggccgggtcccgatcagcttcgaccagctggactccaccgacccggagcatctgctacgccgcccccacctcggtctgtatctgggccggatcgccctcgcgctgctgttcgccctgctggtgaccgagccgctgatgctcgcccggtaccgcggcgagatcgacgcccggctcgccgagacgcacagcgcgcagctgggccggctcgacgcgggcggcgcggtggccgactaccgggcccggctcaccgagctgcgctcggacaccgagaacgacgacgcggcggtccgcgccctcgccgaccgggctgccgggaagcgccgcgacgcccgcgacacgtaccgccaggcgctcgccgactcggccggctccggtgtcacccacagccccggctgcccgcgcaagggtttctgcgaccatctggtccatcgctcccggtctctcgacgagcaggccgcggcgctcgatcggcaggccgccggcctgcagcgcgaccagcgtccggagcgcgcggcccgggccgccgagcagtcccggctcaccgcgctgctcgacgccgagcggacggcgaacgccgacgccgtccgcggcgatgccggtttcggcgcgcggaccgccgcgatgtggcacctggtccgcgcggacttctggggcgtcggcgtgtactacctggggatcgcgctgctgatggtggcactggactgcgccgcgatcgggctgaagttcgcctcccgcgggaacgcctacgagcgcaacgaggcgcgggcggggcggttgtgggagcacgaggcagcgctgatcttcgagcgcgaggtgcacgacgcgcggacctacggggacgcgaccgcgaaggtgatcgccgacggcatcgaggcggcgagcagggatgtggagatcgctcaggcggcgacgcgtcgcgcgcgggcggtgctgcacagcgcggtcatcgtcgacccgtccgacatcgaacacttccgccccagggccgacgcctgatcaccgaaccgagccggagcgcgaagtcaccatcgaattctggaacttcaagatcaaattcatgatgcagatgtcgtgcgctccggcccatcactgatcgctgctcccgccgcaccgggtgcggcgatctggccgctggcgcgtccatgacgatcgccgcacccttccacatccgctgtggggcgcggttagagcgcaagagcagatcaaaggcgaaaccgcaggccggcccgccgcacgtgccgccgtgcgcgtagcggggggtcggcggccggtcgtccggcgtgccgggtgggcggggtcagtcgtccggcgtgccgggtgggcgacgtcggtcgtccggcgtgccgggtgggcggcgcctagctagctagcgggcagcgtgccggggccggcgcgcggtcggtcagcggcggcccagggcccaggcggcgccggcggccaggaggccaccgccgaccgcggcgagcagcccgtggtgctgggaggcccacagctgggcgctgcggtcgctggagcggtcgtcgaaggccccgtgcgcccccgcgtcccggttctcgtcggccggttcccacaggttcaccggctgatccggtgaccgtttctggtcagtctgctggcccttgaacccggtccgggccaggtaccggtcgaggatgccgggcgccaccgcgttcgccgcgagggtcagcgcggtcgatccgcccacccagtattcgcgccgcttcgggtggtcggccgcgtattcgacggcccgcgccgccacctccggctgatagatcggcggtaccggctgtgccttgcgcggcagccgggacagcacccagccgaactgcggcgtgttcaccgccggcatctgcaccatggtgacgtgcacgttgctcttctcgtgcagcagttcgacccgcagcgactcggtgaagccctggatggcgtgcttggcgccgcagtaggcgctctgcagcgggatcccccggtaggccagcgccgacccgacctgcacgatcacaccctggtctcgggtgcgcatccgggacagcgcggcccgggtgccgtacacgtaccccaggtagctcacctcggtggtccgcacgaactccggcatctcgatttcgacgaacggcgcgaacacgctggagaacgcgtcgttcacccacagcccgatcggcccgagttccttctccacgcgttccgcggcggcgtcgacggcctggtagtcggccacgtccacggggatggtcagcgctttgccgccggctcgccggacgtcctcggccgccccttcgagtccttcctcgccgcgggccagcagggcgacggtgtcaccccgggccgccagccgccgggcgaccgcccgcccgatgccaccactcgcgccggtcactaccgaaatcctggtcatgcccgaatgaatgaccgggatccgccaccccgaaacacgcccgccgacgccggcgatccgccaccccgaaacacgccgccgacgccggcgatccgccaccccgaaacacgcccgccgacgccggcgatccgccaccccggaacacgccctgatcagcgctgcacgcccttcgcccgcagcggcaccgtgaacgtcgccccggcgcaggctttcggcacgtcacgcggcatggtcagcgcgtcgtcgagggtgaaggcgccgatcgtgttccgcgccacctcccaggagacccggaacgccgcctggttcacctgcaccgcgacgccggtgcagccggccccacggtggtccgggtcggcgagcacggcgcccgggccgaccgtgatcgaggtgatccggatcggcacggtcttgtcgttggtgacggtcaccatcaggttcccggtggtgccgggccgcaggatctggttgaggtcggtgcgcccgcgcagcaccatgtcgaccacgaccggccccgctccggccacctggcggggctgcgtgatcttccagtacgcccaggccgccccggcgttggcgaggatcgcggcgagcgcggccacccccagaatggtccgggatcgccggtcgaagcgccgtttccgcggtgcccggacctcccaggtcggttcctcggtgtccgcggcggacagttcgatccgcccctccggtggggtgcccccctgcgacgtcagcacgtcccgccggatcatgaggacgcaccggaggcgccggccgcggtcggatcactcggacggggcatgcggctcgttcctcctcggacgccggtggaaaaggccgggctggcgttcatacaacgttccctgatagagatgtccgatgtgatcggttttccgtccgccgtgttaggcgcataaatcggaacgatctacccaaccggtttaccccggcggagggatcggtcactctccagggtcgctgccgcaccgtccatgttgctgcgtgacacgcccatgagctgcactgatgcactcctagcgaggtgtgcccgcgcactcaaatccgcgtccgtcgagccttggtgcgctattgcggcgaggccgccgactcgaccgtcgcgggcgtgccggccgctaccggggcactgctgtccggggccgtcgccggtgccttcgccaccggggcggcggccggcgaggtggtcgcggccgcttcggccgtcgcctgcggcgccggagcgccgggtgtcccgccggtcaccggaggctgcgcggctaccccggcggcgccggtcacggtcttcttgcccggtacgtacgtgacgggcgcactgtcgtcgccgacccacccgccggcccaggcccgcaccacgaacgtgccctgcggcttgccctgcggggcgaatccacagctcagcgccgtggtcgagcagaccgggacggatccgccggaggcgtagacccggtagccgccgaccgctgccccggaggcgaaggtggtgcggtcccaggcgaaggtcagctttccgccggtgaacatgacggtcaggttgcgcaccaccggcatccgttcggcgcggaccgtgccggtggccggcgtggcgctgaccgcccaggtggcccaggcggtcagcccactaccggccgcgatcgccccacccacgatggtcgccatcagggcgagcgcggtccggcgcctcatcggcccaccgtcctcgcggtgccggtgacggtcagccggaaggtcgcccgccggcaggcgtcgtcgaccgttccgggcatgtggacctcgaattctccggcgacggctcgtccccgggccgggacggtcaccggcagccgcccgtggaaccgttcgacccgcaggttccgggccgacgcccggcaccggcgccgggaggtcgatgcgacctgcgcgtcgaccgaccggacgacgatcggatagggataggggttgagcagggtcacccggctgcgccggacggccccggggtagagcccgctcaccgagtcggcccggatcccgaagacgggagtgtcccgggagaccggttccggctcgggtgcccgcaccgcggccgccaccccggcgcagacgaacaccaccccggcggccgccgcccaccactgcccgctgcggagtctgccgttccggaacggcagactccggatccgctcaggccgcattgctgcgtccggtcgcggcgagcgggatggtgaacgtcgccccacggcacgccgagtccgacgcgttggtcatcgtgaccgcgttcgacacccggaatgtctcgtccgccctggccgggatcggccaggacaccgccagcgccggcgtgatcagcgagacgccggtggtgaggcatccggcggtccggtgcgcggcgtctgccgtcaccggcccggagcccgcctggatgagggtgaccagcaccgggaagctgttgccgttgtgcacggtgaccgacagcgcggtccgcttcccggggtacagcggcgcattcggcaggggctgcgccgtcatctgaaggttggtgaccgtccccgcggtggcgctcgccttcccggacccggacaggcgccactgcgcccaggccacgccgccggtgacgatcagcccggcgacgaccgcgacgacgatcacgggcctggcccgcagcgatgatccgaacaaggtgccgttcctgtctcgggaaagggggtggggacgcctgccaggcggccccaccgacgtcaggctgccgcgttgctcttggcgtccaggagcacgtcgaacgtgaacgtcgcgcctacgcagtcgtcggtcgcggcgttgctcatgtgcagcgacccggcgtaggtgatgtccttcttgtcgccgcccccgacggtatctttcgcggcgagctcaagagcgccagcagcggtgggcagcggcgcggtgctgaccgcggtcacgctgccggcgttgcagtcgccagatgccgtgatgttcgagaagtggatgccgttgatcaacaccgggaaggcgttcggattgacgacgtggaatttgacgtcggcattgccgcccggaaccagcggagtggacgacaccccggaaacggtcagggtctgaacgtcgccggcgcgggccgtcgccgagccggtgccggtcagggtccaggcggcccaggcggctccggctccgacgaccgccacggcgacggcggaggcgacaacggcggaacgcttggtcatcttgcgcatgggaaagttcctcctggaacggggttcgagcgcgcggtccccggcggttgcggagcgacgggagcggcgggcgcatcgttgactgggtgtggccggtgcccgctttcggcgtcccggcgctgcgacaaagatggctgacccgcccaggcgcgacgataggtattccagccgggctgttacggatgatctgcccagcccggatgtccattggacgtaccccgcaagcattaacaaagcggcagaagccgcgggaaccgtaaccgtcggctgccgccgggaccgggtgtgacctgcgtcgatccggcgtggcagagcgaggcgtccggctcaaccccgaatgcggctcacatggccggaacgggtccgtcgagggctgccgggatggttgagacgtgaagttttggaaaggaaatgtcggtcgtttgccccgaatggggtaagccgatcaccggagcgttcccctgaaagaggctttcgccctatgcttctgtcggccgctgagcttggagcaggaaccggtgcgcccgcgcggtgaactcgccgcgggcccggatgaccgcggtcaggcgggcgagctcgcgctcgtatcgctgcgggctgaagttgcgcacctgccacgggacggtgcgcagatggtggaccaccgcccggatgtcgcggaaggcgagtgccggatgctcctcgcgcacgtcggtgacccgcagcccggccgcggtcagggcggccgccgcgacctcggcgtcccaccggcgcgggtgtggcggcggggcgccgagcgcgtcgttcagctcggccaggtcgtcgctgccgacctgctgggtgagcagcacaccgcccggcttgagcaggcgggcgatgtccgcggccggcagccggccatggcggctgagcaccacgtcgaactcgtcctcgccggccggcagctcggtgaggacctcgacgccgaacggggcgagccgctcccgggcgatcggggtgttgcgggcccagctctccaccgccaccgtgcacgccggcaggggggccagctcggccagcagctcgccgccgccggtgtccaggtcgagcaggctgcgggccgggcgcaccagcgggcgggcgatctccacgtacgaccaggacggctcggccgcgacggccagcccgtccagccaggcgaactcccacccggtcagggacgagccggccgccgcggtgttgaggtcgtcatccggcgggctgctgcgcacacgccgacggtaaccagagcgtgcgctcaaagtcgcgatggtctcagcgttcacggaagtcgtggctgaaccgtgttcaatccgcgactcaacgcggccgacagtcagccgcggaccggcatgagcagggagaaacgggattcatcggcggcactgcgaatgatcagcggtcggaccggcccgtccagctccagcagcagctggccggggccgcccgcgtcggccgcctggagcaggaactcgcggttcaccgccacgtgccgcccggcgtcggtggaccactccgactcggcggccagacgcaggccaccgtccgggtcctcggccaggatcgtcaccgggtaggtggcgccgtcgtgctcccggtgcacctccggcgcgtcggccagcagctcgcgcagctcggcggggtcgacgccgatccggcgaccgggcccgggaacgagccggcggtaatccgggaagtcggccgccaccggggcggcccgcaggtcgagatcgccggccgtggcccgcagcgagtcgtcgtcgacgtcgagggtgacggtgccggtggtgagccccagcagccggtcgacgaagtccagcggcagatagtggcgggccggtgagccctcgacggcggccggggtcgcggcgaccgcgagccggtagcggtcggtggcgaccagggtcagcgtgccgtcggccgcctccagcaggactcccccggggaacggggtgccggggatcgggtcggtggtggcgaaccggaccgcggccagcgtggcccgcaggtcggcggcggacagggtgatgcgggtcatcaggtgctcctccaggtcgagcagggtgtgcaggcggaggagttcggtgcgggcgtcggccaggccggcctccaggcgggccaggtgggcgtccagccgatcacgtacccggtccgggtgcccgaggtcggccaccgcccggctgatctcggcgaccggcatcccgacccggcgcagcccggcgatcagccgggccgcccggatctgctcggccgagtaccgccggtagccggtgtccgggtcgaccacggccgggaccagcacgcccgcgctgtcgtagaaccgcagggcgctgaccgtcaggccgctggcccgggccgccgcaccgatcgtccgcatcgcactcctcacacccgccgaccctggggcctcgaccaggtcgagggtcaagcctggagcaacagtgtgccgccgagggccgccatgaccagagctatcgcgccgtccaggacccgccaggcgttcgggcgggccagcagcggggcgaggcggcgggcgcccaggccgagggcggtgaaccaggtcaggctggccagcgcggcgcccaccccgaaccaccagcggtgcgcgtgctgctgggccaccgagccgagcagcagcacggtgtccaggtagacgtgcgggttcaggtaggtgaaggccagacaggtgagcagcgtggcgcgcagggtggcgggggcgcggccggtcggatcgaggctgccggtggggcgcagcgcccggcgggcggcgagaaccgcgtacgccagcaggaagatcgcgccgatccagcggatcgcggagaccagtcgcggctgcgcggcgatgatcgcgcccaggcccgcgatgcccgcggagatcagcaggacgtcggagagggcgcaggtcaggacgatcggcaggacgtgttcccggcgcaggccctggcgcaggacgaaggcgttctgggcgccgatcgcgatgatcagcacggcggaagcggcaaagccggccacggcggaggtgagcacgatcccgacgctacggttcccgatcggctgaactccagctaaagaatttcaggatggattagcgatacttaatcgtggaccaggtacagctgcagaccttccaggccgtggtggagcagggctcgttcgaggcggccgcgcgggtgctgcacgtcaccccatcggcggtcagccaacggatcaaggcactcgaacgggccgtcgggcaggtgctggtgcgacgggccaaaccgtgcacggccaccgaggccggccaggcgctggtccggttcgccggacaggtggccctgctggaacgggaggcgctggcgcaggcgcgcggcgggacccgggtgtcgatcgtggtgaacgccgactcgctgaacacctggttcatgccggtgctcacccgggtgccgggcgcgaccttcgagatacacaccgacgaccaggactacaccgccgacctgctgcggtccgggacggtgatggcggcggtcaccgcggagaacgtggcggtccagggctgccgggtcgaggagctcggcgcgatgcggtatctcgcggtggcggcgcccggcgtggacttcgcgaccgctccgatgatcatctacaaccggaaggaccggctgcagcaccggttcctggaactggccgggctgacgccgcgcgatccggtggtccactacgtgccggcggcggcggccttcaacgaggcgatccggctggggctgggctggggaacggtgccggagcagaacgcccgggccctgctggactccggagaatacgtccagatgtttccggacaggttcctggatgtgccgttgtactggcagtactggcgcatcgagtcggctttgctgaacacgctgacggccgccgttcgcgaggcggccgtcagctcactgcgtaccggatgagcgccgttgatctctcaatcgttggcgtgcagagcgctgttcagctcgatgccggtgcccttgcgcgggcgggcctccagggcgccggagaccgagttgcgccagaacaggagattgctcacaccggacagctcgatggccttcaccacacggccgtccggcagcgacaccttcgacgaggcggtgatgtagacgccggcctcgaccacgcagtcgtcgcccagcgagatgccgacgcccgcgttcgccccgagcaggctgcgctcgccgatccggaccttctccttgccgccgccggacagggtgcccatgatcgacgaaccaccgccgatgtcggacccgtcacccaccaccacgccctgcacgatgcgaccctccaccatcgaggtgcccagcgtgccggcgttgaagttgacgaatccctcctgcatgatcgtggtgcccggcgccaggtgcgcgcccagccggacccggtccgcgtcggcgatccggaccccgctcggcgacacgtaatcggtcatccgcgggaacttgtcgatgccgtagacggccaggtgccggccggcggcccgctccaggaagcgcagctcgtcgacccggtccggcgggcacgggccggccgaggtccaggcgacgttggccagcaggccgaagatgccgtccagattcagctcgttcggccggatcaggcggtgcgagagcaggtgcaaccgcaggtaggcctcggcggtgtcggcgatcggctcggccagcgacttgaccgtggcgcggacctcgaccgtggccaggccgggcagcagcttggggccggtcagcccggccggcagcgccggcgcctcggccggctcctcacccagacccaggaaaccggccgggaaccaggtgtccagcacctgcccgtcggcggtcacggtggccaggccgatgccccacgcgggcgaagtcgagatcgcggtatccacggcatgaaccctactaggcggggaggcccctgatcgggtgcgtccggtgctcgggacggccttgtatggtgcgcacatggccaacccgctgaccccggacgtgctggtcgacccggtcgagttgacccgtgccctggtcgacatcgcctccgtgtcccgcgacgagaaggtgatcgccgactgcgtgcaggacgtgctgcgcgaggccggtcacctcaccgtggaccgcgtcggcaacaccgtgctggcccgcaccgacctgggtcgcgcgcagcgcgtggtgctcgccggtcacctcgacacggtgccgatcaacggcaactttccgtccacagtcgtcgacgacctcatctacggctgcgggacggcggacatgaaatccggggtggccgtggcgctgcacctggccgccacgctgcccgacccggcgtacgacgtgacctacctgttctacgaggccgaggagatcgagcacgagttcaacgggctcaacctggtcgcggccggcaaaccggaatggctccgagccgacttcgcggtgctgctggaaccgacgtacggcgtggtcgaggccggctgccagggcaccatgcgggcgctggtgcgcacccacgggcgccgcgcacacaccgcccgggcctggcgcggggtgaacgcgatccacgcggccggcgaggtgctgcgccggctggaggcctaccacccgcggaccgtgacgatcgacggctgcacgtaccgggaagggttgaacgccgtcgggatcaccggcggcgtggccggcaacgtcgtccccgacgagtgcgcggtcgaggtcaacctgcggttcgcgccggaccggtcgcaagcacaggccctggaccacctcaacgaggtgttcgccggcttcgacctggcggtcaccgactccgcccccggggcgctgcccggcctggacgcgaccgccgcccgggaattcctcaccgcggtcggggtggcgccggccgccaagctcggctggaccgacgtggcccgcttcgcggcgctgggcatcccggcgctcaactacgggccgggcgatccgtcgctcgcccacgcgccggacgagcacgtcgagatcggccagatccgggacagcgccgcgaccctgcaccggtggctcgccggttagtggctgatcacggcccggccgatcgcccgctgaggcagcgtgatctccatggtggcctccgggtcggcggccggatcggcagcctgcgccgcgaaggcgatgcggcgttgctccaccaccagctggatccgccgctgcatgcgacggtgcatccggaggcgctcgtatcggttcgtcacggtggccgccctctcgccgggacaccctgttccgggcgccgtgcctgccgtgtggacgcggttcggtaactgtatagacgcaccagagctaccgtccgttgcttcaatctggcaaaaaggtctccgcgtcgcaatcctcttgccgaaacgcagcccgttattcaccgggtactggccgtccgcactaccttggacgcatgacggagagcaccaacgagcgaccaccggccgcgccgcagcgtcatcgaggtgcggtcacgctgcgtcgggacgccgtgccaccgagcaccgccgacgagaaactgctggactcgcaccatcgcggtgagtggaagaccaaggacgcctggcgcgcgctgcgcatcctgtcggaattcgtcgagggcttcgacacgctggccgacctgccgcccgcggtcagcgtcttcggctcggcccgcagccggccggacagccccgagtgcgaactggccacccggctcggcgcggccctcgccgaggccggctacgcggtgatcaccggcggcgggccgggcgtgatggaagccgccaaccggggcgccaccgaggccggcggaatgtccgtcgggctcggcatcgaactccccttcgaacaggggctcaacgactgggtcgacatcggcatcgacttccgctacttcttcgtccgcaagaccatgttcgtcaagtacgcgcaggcgttcgtggtgctgcccggcggattcggcacgctggacgagctgttcgaggcgatcaccctggtgcagacccgcaaggtgacccggttcccggtgatcctgatgggcgtcgactactggagcggcctgctcgactggatcaagcggcggatgctcgacgacggcaagatcagcgaggccgacctgggcctgatccaggtcaccgacgacgtcaccgaggcggtccggatcatcgtggcggccggtgcggcccaggcagccgactgatggccgcgatcggtgtcttctgcggctccgccgacaccgtcgaacaacgctggctcgacctggccgccgagaccggccgggcgctcggcgagcgcgggcacaccctggtctccggcggcggccgggtcggcatgatgggcacggtcgccgacggcgcccgggccggcggagcgcacaccctcggcgtcatcccgcagtgcctggtcgacggggaggtggccgacaccgcctcggacgagctgctggtcaccgacgacatgggtgcccggaagaatctgatgatcgagcggtcggacgcgttcctcaccctgcccggcgggctgggcacgctggacgagctgttcgaggtgtggacgacggcgacgctgcgggtgcaccgcaagccgatcgtggtgctcgacccggacggcttctacgacggtctgctgggctggctgaccgggttggtcgcgaccaggttcgtgcggcccggggcgatggagacggtgcgggtcgcccggtcggtgccggaggcgctggacgtcatcgagaccctcctggtggcgcccgcggagtgacggcgcttacccgggctcccggaaacgtcgtaccggcgtgctctcatagatgccgtgagcacgccggccccccattccccggtgcgccggcccgactaccgcctggtccggcgtccccgcccggccgcgcccgagctgcgcgccgacccggtccagacccgggtggccgcgcacacccgcggtccgctgctggtcgtcggcggccccggcaccggcaagaccaccgcgctggtcgaggcggtcgccgcccgcatcgccgagggcgtcgacccggagcggatcctggtgctgaccttcggccgccgcggcgccgccacgctgcgcgaccggatcgaggcccgggtcgccgacgtgcccggccgcatcgtccacgagccgctggtccgcaccttccacgcctacgcgttcggcctcctgcgccgggccgccgccgagcgcggcgagccggccccgcgcctgctcaccggtcccgagcaggatctgatcatccgcgagctgctggccgtcgtcgaggacgaggacgccgccgacaccatcggctggcccgagtcgctgcgcccggccctgcccacccgggccttcgcccagcagctgcgcgacctgatgcagcgcgccgccgagcgcggcctcggcccactggagctggccggctacgccacccggctcggccgcgacgactggtcggccgccgcccgcttcctccgggaatatgtcgaggtcctctccctgcgcgacgccaccacccggggctcggtcgcctacgacccggccgagctcgtccgcgccgcctccggcctgctcaccgacgagcccgacctgctggccgccgagcgccgccgcctcgcccacgtcttcgtcgacgagctcgccgaaaccgacccggcccagatcgacctgctcgcccaggtcgccggcggcggcaaacccctggtcgccttcgccgacccggactcgtccatcttcggcttccgcggcgccgaccccgaggtggtggcacacttccccgaccgtttccgcgggccggacggctcaccggccccgacggtcgccctgcacaccaactatcgggcggcgccggccctgctcagcgcgacgtccggggtggcccggcggatgcgcgggccgatcgcccaccggccgatgttcccaccgcctccggccgccccggccccggtctccggctctgcggccccggccccggtctccggctccgccgccccgggtcccgtcgtggcggcctccgactcggcggcggttggttccggcgcggtgtcggggcctgttgtggcggtctctgagtcggcggcggttggttccggctcggtgtcggggcctgtcccggcggcctcggagccggccgcggccggctctgctccggtcgacggggtcccggccgcccgggtgccggccgcggggccgggcccggttcccgaggcggggatctcggcggacgggccggtggccggggcggtggtgcggacgttccggtcgccggcggcggagaccgcgttcatcgcgcacgcgctgcgggaggcgcatctgctctacggggtgccctggtcgcggatggccgtgctgatgcggtcggcgaccctgcagcagccgtcggtgcagcgggcgctggccgcgtccggggtgccgaccgtgatccatgccgaggatctgccgctgcacctgcagcccgcggtggcgccgttcctgctgttgctgcggtgcgcgctggatccggagcggctcgacgaggaagcggcggtcgcgctgctgcactcgccgctgggcggggccgacccgctcgccgagcggcggctgcggcaggggctgcgggcgctcgcgctggccgccggggatcggcggccctccggagagttgctggtcgacgcggtgcgcgaccccgccggtctcgacctggtggaacgccgctgggcccgcccggcacagaccatcgcccggctgctgaccgtggcccgcacggccgccgccgcgccggccgcctcggccgaggacgtgctgtggacggtgtggcgggccagcggcctggccgaccggtggtacgcgatgagcaccggcaaccgccgcccctcggacgccgcgcagtccggccgggcccgacagtggcgtgccgaggccgccgaccgtgacctcgacgccatggtggtgctcttcgacgcggccgcccggttcgtcgaccggctgcccggcgccggtgtcggcgtcttcctggagcatgtgctcggccaggatctgccggccgacaccatcgcgcccagcgccgatcggggtgacgccgtccggctgctcaccgcgcacgcggcgaaaggcctggagtgggacgtcgtggtgatcgccggcgtgcaggagggcatctggcccgacctgcggctgcgaggcagcctgctcggttcggagcgtctggtcgacgcggccgccggccggcccgcgaccggttcggaggcgatcgtggcgcagacctccgccctgctcgacgaggagcgccgcctgttctacgtggcggccacccgggcccgccgccggctggtggtcaccgcggtggcctcggcgagcagcgggggcgcggcgatcgaggagcagccgagccgcttcctgaccgagctggcggctccggggccgcgcccgggcgaccccggagccggcccgccgctgccgcccggatcgacgaacccggacgatccggggccgccgctgcctcccgagccgaccgaccccgacgatcccgggccggccgacgacgacttcccgccggatccggacaccgtgccgggcgagagcaacggggctgacggcgacgaccgcaacgcgatgcgggacggtggtgcggcccgggacggcggtgccacgcgggatgttggtacggcaggggacggtggtgccgcccgggatggtggtgcgggggagagcggtgcggcgcgggacggcgatgcggcgcagcagcacgcagcggcgccgggcggcgaagccggccaggacggttcggcggggcaggacggtgacggtgcggcggggcaggacggtgcggcggggcaggacggtgacggctagctagctagtgagggcgagctggcggtcgggcgggcaccccgggcgctcacgctcgcggcgctcgtagcggaactgcgtacggtcgtggtcgcttctggagagacgcccagccgccggcgcgcagcggcggccgagctggcccgcctcgcggccgccggcgtgcccggtgcccatcccgacgagtggtggggcctgcgaccgctctccgacgaccggccgctggtcgacgacggcgagccggtcaaggtcaccccgtcggcgatggagagcgcactccgctgcagcctgcgctggctgctggaacgccacggcggcgcgcccccggccggtccggcgcagggcatcggcaacctggtgcacgccgccgcgatgctggccgaggacgcgcacgccgaccgggagaggctggtcgagtacgtgtcggcccggttcgactcgatcgagctggccgcccgctggatggccggcccggagcaggaacgcgccgaggccatggtggacaaactgctgcgctggctggccgcgaacccgcgccggctgctggcgatcgagcacgagttcaccgtgcggctggccgacgagcgccgtccggtgcagctcaccggccgggtcgaccggctggagatcgacgaggcgggccggctcgtggtgatcgacctgaagaccggcaagtccaccgcgctctccgccgacgtggcggagaacccgcagctggccggctatcaggcggcggtggacgcgggcgcgttcgccgactacggcaccgacagcgggggcgccgccctggtccagctcggcccgggcaaggatgcccgggagcagatgcaggtgccgatcaccgaggccaccgacccgcagtgggcgtaccagatggtgcgccgcaccgcggacacgatggccgctgccacgttctcggcggtggcgaacagccgctgccgggtctgcccggtgcgcaccagctgcccggtctccgggaagggtcgccaggtcgtggagccaccgaaggatcagtcgtgagagccgccgccggcccccgcttcaccccggccgacctggccggcctgctccggctgccgccgcccaccccggaacagacctcgatcgtcgcgtacccgatgaagccactgctggtggtggccggcgccggctcgggcaagacggagacgatggcgtcccgggtggtctggctggtcgcgaacggctacgtgcatcccggcgagatcctcggcctgaccttcacccgcaaggcggccggcgagctggcgcaccgggtccgcacccggctcggccagctgatccggcggatcgggcgggacgacgggttcgccggcgaggcgaccatctccacctatcactcgtacgccgcccggatcgtcaccgagcacggtctgcgcggcgggttcgagccgtccgcccggctgctcaccgaggcggcccgctggcagatcgtcgactcgctggtccgggcgtacaccggggagatgaccgggctgaaccgcgcccccggcacggtcaccgacgacgtgctgtcgctctccgccgagctggccgagcatctgcgctccccggacgacctggccgcgtggaccggccggttcttcgccgagctgcaatccttccccgggcggatgtacaaggacgtgtccgaggtgctgcggcgtcagcagcaccggctcaccctgctgcccctggtgcgcctctacgagcagcgcaagctggacctggaggcgatggacttcggcgaccagatgtcccgggccgcgatcgtcgcccgcgaccatccggaggtcggcgagatcgaacgcgggcggtaccgggtcgtcctgctcgacgaataccaggacaccagccatgcccaggtggtgatgctgaacaacctgttcggcggcgggcatccggtgaccgcggtcggtgacccgtgccagtccatctacggctggcggggcgcctcggccggcaccctggaacgctttccgaccgagttcccggactccggcggccaccccgcctgggtgcacagcctgacccgcagctggcggaaccgcccggagatcctgcgggtggcgaacaccctgtcggccccgctgcgggcccaggtgggcgtgttgcagccggcggagcgggtcgccgaggcggtcgggggccggacggtcacctgtgcgctgctaccgacgtacgcccgagaggcctcgtggatcgcggaccagatgctgaccgcctggcggatcgccgccggcatgccgaaggcgttgccggaggagattccgctggagcgccgcccgaccagtgcggtgctggtccgggtgcgcagccagattccggtgctggaggaggagctgcgggcgcgcggcctgccggtcgaggtggtcgggctgggcgggctgctggacacgcccgaggtccgcgacgtggtgtgcacgctgcgggtgctggccgacccgaccgacggcgcgtcgctgctgcggctgctgaccggcgcccgctggcggatcggcccgcgcgacctggtcgccctgcaccggcggtcccgggcgatcgcggcggcgcggacgccggtcgatgagccggagggggtgctggccgaccggctcgacgacgccaccctgatcgaggcgatggccgacctgggcaccccgcaccagtattcgaccgagggcttcctgcggctggccgcgttcagccgggagctgtccgccctgcggcagcgcctcgaccagccgctgcccgatctgctcgccgacatcgagcggacatccgggctggacgtggaggtcgccgtccgcggctgggcggccggggacgccggtctggcccgggcgcatctggacgcgctcggcgaagccgccacccggtatgtgaacgagaacgaggccggcacactcaccggcttcctggccttcctggccgccgccgaggaggaggagcgcggcctcgaacccggccaggtcgacgtcgtcgagggcgccgtccagatcctcaccgcgcacgccgcgaaaggcctggaatgggacgtcgtctcggtcgccggcctgtgcaagggcgtctggccgggcctggtccgcgcctccgaccactacctcggcggcatcggtgtgctgccgttcccgctgcgcggcgacgcgtccgggctgcccgagctggacctggaggaggcggtcgagcagaaggacgtgaacaacgcgctcggcgggttcgcccggtcctggcgggaacacgacgagcgggaggaacgccgcctggcgtacgtcgcggtgacccggccgcgccgcctgctgctctgctccggctactggtggggcgacggggtgaaacgtccccgcgggccgtcggtcttcctcgacgaggtgcgtgcgacctgcgcggacggcgccggggtgatcgccgaatgggcgcctgagccggcgcccggggagacgaacccgagcgaggaggtggtggcgaccgcggaatggccggcggatccgctgggggtgcgccggccggcgatggccgcggccgccgacctgatccggcgcatgatcgccgacccggacgcttcggccgcggccgccttcgccgacctggccacggagaatccggaggtggcggcgcgggccggcctcgcggccgatctggtgggcatcgccggcccgggttcgctcccggtccgctcctcccaagatcatcaattggcggtacgccacgagcctcccgccgtgcctcccggctccgctgtgcctcccggctccgctgtgcctcccggctccgctgtgcctcccggctccgctgtgccggccggatccgcggagtctctggcgtccggtgacgggccgggctcggtcgggccggccggctcacccgaagccggcgtgcctgcggtctcctcggcaccttcggcggccgctttccaggctgccgatgggtccggcacggtttccgcgtcgcgcgatcgggcgggcctgcttgccgcggcggccgccgcggaccgggtggccgccgcggccgacccggacatcgcccgctggcgcaacgaggcgagactgctgctcgccgaacgcgacgaacgcacccgccacggcggcccgatcgaggtggcgctgcccccgcacctctccgtctcgcagctggtcgtgctgcgccgcgatccgcagtcgctggcccggtcgctgcgccgtccgctcccgcagcgcccggcgccgcacgcgcggcgcggcaccgccttccacgtctggctggagcagcgtttcggcgcggcccggctgatcgacatcgacgagctgcccggcgccgccgacgaccaggccgccggcgacgaggaactggccgagctgcaggaggcgttcctgaccggcgagtgggcggaccgcaccccgatcgacgtcgaggtcccgttcgccaccacgatcggcggcgtggtcatccgcggccggatggacgcggtcttcgccgacccgggggaccgcttcgacgtgatcgactggaagaccggccgccgccccaccggagccgaggccgaggccgccgcggtgcagctttccgcgtaccggatcgcctgggccacccttgccggggtgccgatcacccgggtccgggccggtttccactatgttcgcgagcaggtcaccgtccgccccaccgacctgctggacgtggccaccctgaccgccctgatcaccgagatcccggaggaggcgctctgaccgcttccggtgccgagtggtcgtgaccgcccaggagccgacgaacgctgatcgcctggggagccgagtggtcgtgaccgccccggagccgacgaacgctgaccgcctggggagccgagcggtcgtgaccgcgccggagccggccgtcttcgccgcggcccagggtggctgcgcgcctggcaggtggcgaggccggcggcccggaccggatgcctgggtgaagtgtgcggtggacaggtcaggggaggggctgggccgcgccggcggcggtgagcaggtggcgcagggcggtggcgtaggccgcctcggcggtcgggcctgcgaaggtgagcgcctcgccgagcaggtcgatgctcacccgatagtggccgccatcccggtcgagggagcggaacgtgccgccgagcagttcgcgcaactggtcctcgcggggcagccagatcgtctcgtcgatcgccacgtcgtcgagagcccattcggtggtgccgttgaagccgaggatccggccctccgggcggtcgtggacctggatcgtcatgttgctgagcacgaaaacctcgtcgtcgaggtcccggtcggggatcgcgaaccggtcgccgaggcgaggtttccaggtcagcccggctgcttggagctgccgtgccatgtctatgccgagcacttcttgacctccgatgccgtgctaggctacttccgttgtcagtttggttcccaagtactcaggagcgcctgtggggaagtctgccccaggcgctctttgtcgtaacccgggtttctccggtacgggcgatcagtacggcgacacgagtcccgcagaatgcgggtcttattacctcgttcacgctcataatgggcgggaacgatcgaccgtcgaggagacgatcatggttaccggcgtagtgaagtggttcaacgcggacaagggcttcggattcatcacccctgacgacggcggcgccgacgtcttcgcccacttctccgcgatccagatgtcgggctaccgcagcctggaggagaaccagcgggtcgagttcgaggtcacccagggccagaagggcccgcaggccgcgaacatccgttccgtctgatccgcaggtgatcaccggctgccatccggcggccggtgaccagtacgcgaaaccggcgccacacccaccagggtgcggcgccggtgtcattcgcccaccgtccgggcgccggtgtcattcgcccaccgtccgggcgccggtgtcattcgcccaccgtccgggcgccggtgtcattcgcccaccgtccgggcgccggtgtcattcgcccatcctccggccgcccgcccgcgccccgaacaggcgacgccgggaatatcgggcgggaccggtgagcgggtccggggccgcagaaggcaaggctccgggcggacccggagccttgctcgtcgatcagtgcggaaccgcttgcctcagaccgcggcggccggtcgcggcagcggcgcggtcccgccgaggtgggcgggcagccaccagcggtcgccgtcgtcggccggtttctccgggtaggccctctgcacggcgtccagcagcgaggtgagccgctgcttgaggatcaccgtgacggcctcggcggtggcgccctcgggcatcgagatcgcctcgccgatcttgatcaggaccgggacgtggcgtttggtgagttccttcttgcggcccttggtccagagccggtgcgggccccacaccgccatcgggatcagcgggacgccggcctcctgagccattcgggcggcgccggtcttcaactctttgacggtgaacgactcgctgatcgtcgcctccgggaagacgccgacgatctcgccgttctccagggcggtggtggcttcgcggaaggcgccgaggccggctttgcgatcgaccgggatgtgccgcatgccgcgcatcagcgggccgctgaccttgtggtcgaagacggacttcttcgccatgaagcgcaccagccgcttggccggttgagcgccgaagccgcagaagatgaagtccaggtagctcgaatggttgctggccaggaccgccccgccggtggtcgggatgtgctcgccgccctcgacctcgatcttcaggtcgagcacgcggaacatcgtcttggccaaggcgacgaccgggggatacaccagttccatggcagcacggtagcggacatttctgggaaccgactgggccgggtggcactttgtccagcgtgtttcgccgtgcacgcccgggcggcggcgcacccgatggtggtgttgactggtggtcatgtccgagccgttcccgcagcagtccgcctggtcccggccgggtggggcgtggtcgtcgggcacggtcaccggcatcggcgtaccgccgcaatcgccgccgccgccacccgcctcgccggaaccgtcgcgacggtccggtccggagcgtcagcgacggcagttgttgatcttcggtggggtggccgggctgatcctgtccggcggcctgatcgtgctgctggtgatcgttttcagcggggacgatccgttcggccaccgggcgcacgcaccgaccgatgtccgcccgccgctggcgcaggcctgccccgcgccgaccgatccgccgggtgccgcgccggctcccgcaccgtccgcgccgcccgccgcgaccggcgcgcggaccgtggaccgggaggcgggcatctcctaccggcagtacggcgcgccgtggcgggtctggaaccaggtgtggcgggccggcacgctgaaggtcaactacaaggtcggccagcatttcgtgaccgagacctacagtgccggcgactatcacgcgtcgatcctgtcggcggcggtgccggcggccgacaacgacgcggtcaccctggatctgcagtgcgtgggacggcaggtcgccgcggacgtgcgggccaactactacccacagccgaacaccctggagccgctgcgcgacgaggtgaccacgctcggcgggcggcccgcctatgtcagcgagttccggctgcatttccacgcggccgggctgaccgccacctcggagctgtccgcggtggcggtcatcgatgtcggcaagccgtcggcggccgtgctctacgtgtccatcccgggcacgcaccggcagttcgactacgtgatcgacgacgtgctgagctcggtccggccgctgtgatcagctgccggtcaggccccaccgcttgcgcagggcgttgtcggcggcgttgaagagctgatcgatgcagatgccgatgatcagtacgacgaggatgtagcagatcaccagcggggtgtcggccaggtcccgggcgttctgcatgcgcacgccgatcgacaccgtgccgggcacgatgacgagcagctcaccggccatcaggctgcgccaggagaaggcccagccctgcttgagcccggagacgaaggacggcagcgaggccggcaggatcaggtgccgatagcggtcgaaaccggacatgcccatcacctggccgacgcgcagccaggtgcgcggcacgtagtcgatgccgctgatcaggccgttcgccacggagggggcggcgccgatcacgaccacgaacaggatggccttctcgccgagctggaacagcaggatggcgagcgggaaccacatgatcgacggcatcgtctgcaggccggtgatcagcgagccgatcgcggcgcgcagcggggcgaaccgggacaccgcggcgccgatcaccgtgccgatggcgaccgccagcgcgaagccggtgatcgcccgggtcatggtcaggcgcacgccgtcccagaagtcggcggtggtcaccaggtcccacagctgcgggaagacgtcggtgggcgacgggaagacgtacgacggtttccagccgctgacgtaggcgatctcccaggccagcagcacgatcccgatggcggccagcttgggccaggcgctcttccagatccgcaggccgaggttgccccggtcgcgctcgggttcgaggtcgagcgcgtcgaggccgctgacctcctgctcgctcagggtcttgatcttctgcgggagcggaccgtaaccgtcgtccggcgcgaacgttccttcgagcgcggcgcgcgcggaggagagaggttcagtgggcatgacgggcgacctccgcacggagccggtcggtgatctcggcggcctggccggagacctcgggggagtcgatgcgccgggggcgcgggtgtccgatcttgaagtcctcgatgacccggcccggccggctgctcagcaggatcacccggtcgccgaggcggaccgcctcgcgcacgttgtgggtcacgaagagcacggtcagctcctgctcgcgccagatccgttccaactcgtcgtgcaggatgtcgcgggtcatcgcgtccagggcgccgaacggctcgtccatcagcagcacgtcggcgttctgggcgagggcccgggccagcgcgacccgctggcgcatgccaccggagagctcgtgcggccgcttgtcgccgaagccgcccagccggacgatctccagcagctcggcggcccgcttccggcgttcggccttgtcgatgccctgcagcttcagcggcagctcgacgttgccggccacggacagccaggggaagagagcggcctcctggaacatcagggccaccttgcggccgccggtgttcagggtgccgccgctgatcttgtccagcccggcgaccagcgagagcagcgtgctcttgccgcagccggaggcgcccagcaggcagacgaactccccctgctggacgtcgagggacacacggtcgagggcgagcagcgcggtgctgcccgaaccgtactgcttggagacgttgtcgatctcgaggatgttcatgcgtgcccgccctcccgtcagatggttcgtcaggcgcccgcggcgtcgctgaccgcgggctgaccggccgccttgagcaggtcgttcagcggaccgaggtcgtagatgcccttcaggtcgaccttcttcagcagaccgacgtcctcggcgtgctgcgcgctggtgtacagcgacgacgcgatcgggtcgttggtgaacttcaggttcttgaacgcggcggccaggatgtcgtccttgagcgccttgccggtgagcgcctggatctgggcgttcgccgccttctgggcgtcggcgttgttgtcgttgatgtacttgaccgccgcgatgtggccttgcagcagcttcttgaccgtgcccgggtagtccttgaggaacttctggctgacgatcaggtgggtggtgacgaactgctggttcggccacagggtggcctcgtcgacgagcagcttgcccttgccctccagcaccatcttgctgaggttgggctcgggcacccaggcgccgtcgatcgcgccctgggcgaaggcctggaccgcggtcgcgttgtcctgcggcaggatcgacacgtcgccgccaccgttggtgtcggcgttcaggccgttctgcttgagccaggcgcgcagcgcgacgtcctgggtgttgcccagctgcggggtggcgatcttcttgcccttgaggtcggccgggccgttgatggtcggcttgaccaccaggccggcgccgcccgaggtgctgcccgcgatgatcttcagggcctggccgttggacttggcccagccgttgatcgccgggttcgggccgatgtaggtggcgtcgatcgcgccggagagcagcgcctcgagcgcggccgggccggcgttgaaggtctgggtctgcagctcggtgccggtcagcgcgtccttgaacaggcccttgttgacgccgaccagggccggcgcgtgggtgatgttcgggaagtagccgagcttgatggtcttcgcctcggccggcgtgccggccggagtgtcggccttcttgctgctgtcgtcgtcggacccgcaagcggccagagcagtcgtggccgcgagcgcggccgtggcaagggcgagcgcacgaagggtgcgggagcgcatgctcaacaactcctagttcttctttattgaggtggtggagagttcggccagggtccggtggtcgaccacgccctcgatggccgcctcgacggcgatccacacgtcgtgcagtgcgatcgccgcgccgtgataggtcgcggtggcggtggggaggccgcggaccgtggtgagcgcgccgccgacggcgcggaccacgtccccgacggtgatctcctcggccgcgcgggccagggcgtacccgccgtcgacgccgcggtggctgtgcagcagcccggcgcggcgcaggtcgagcaggatgccctgcaggaagctcagcgggatgtcctgcgcggccgccagcccggcggccttgaccagacgtgggtgcgccgcggtgacggcgagcatggcgcggactgcgtagtccgtgcgagccgagacgtacacggcgggccccctcccggtggatcaaacttcgcttaatctatctgttggatgggaatagtggaacagagaggtttggtgcgtcaagtcatcgaccggatggcgggaccccaccgggggatcacccagcgcgctaatgtcactccgtggcgtccagaatccagatccccgcgacgaaatatccggtcgaacggttcaccctcgccaacggtctgcgcgtggtgctctcgccggaccgcagcgccccggtcgtcggcgtcgccgtcgtctacgacgtgggcatccgcagtgagcccgaggggcgcaccggcttcgcccacctcttcgagcacctgatgttccagggctcggcgaatctggagaagctcgcccacttccggcacgtgcagggcgccggcggcagcttcaacggctccacccacctggactacaccgactacttcgaggtgctcccggccggcgcgctggagcgggcgctgttcctcgaggccgatcggatgcgcggcccccggctcaccgaggagaacctgcgcaaccaggtcgacgtggtcaaggaggagatccgggtcaacgtgctgaaccggccgtacggcgggttcccctggctgaaactgcccccggtgatgttccgcacgttccccaacgcgcatgacggctacggctcgttcgaggacctggagagcgccaccgtcgacgacgcgcagggcttcttcgaccgctactacgcctgcggcaacgcggtgctctcggtcgccggcgacttcgacgtggcggaggcgaccgccatgatcgagaaacacttcggcgacgtgcccgcccgccccgccccggtgctgcccgccttcgacgagcccggcctcgacggcgagcgccgcgagtcgtacgtcgaccgcctcgccccgctgcccgccgtcgcggccggctaccgggtgcccgacccgatcgccgccttcgacgcctacctgcccttctcggtgctcgccgaggtgctcaccgacggcgacgcgtcccgcctggtcgaacgtctggtccagcgcgaccgcacggtcaccaacatcggcggctacctcggcttcatgggcgacgagtaccaggtgcgcaacccgaccgcgctgctgctgcaggcacacctgccgcccggcggcgacgccggcaaggtgctgcgcaccgtcgacgaggagctcgaccggctggccgccgacggcctcaagcccggcgagctggagcgcacccaggcccggatggcggcccgcgcgctgcagagcaccgacgaggtgctcggccgggcactgccgatggccgtgctggagctgcagcgcggccggcccgagctgctcaacgagctgcccaagctgatcagcgaggtgaccgccgagcagatcgtcgacgccgcggccaccctgcggccggaacgccgcgccaccgtcgaagcgatccccggagccacctcatgaccgagatcctccccgacctcatcccggacaccgagctgacactgccgccgcaggccgagcggaaactgccgaacgggctgaccgtgatcgccatccggcgcgccgcggtgccgctggtcgaggtgcgcctgcgggtcccgttcggccgcgccccgctggccccggccaccctgctctcccaggcgctgttcaccggcaccgagacgatgacgatgctggacatcgccgccgaggtgcaggcggtgggcggcagcctggccgcggggctcgacccggaccgtctgatgatcagcggcaacgcgctcgccgacggcctcggccggaccctggagatcctcgccggcgtgctgaccggcgcgacctacccggccgacgaggtgctcaccgagcgcgagcggctctgcgacaacctccaggtgatgctcagccagccggcccacctggcccgggtcgcgctgctcaagcgggtgtacgccgaccatccctacgccgtgcagacccccgccccggaggaggtccgggcggtcgagccggatgccctgcgcgagctgcacgccgaccgggttcggccggccggctcgatcctggtgctggtcggcgacatcgacccggaccaggcgatcgacctcgccgagaagacgctgggcggctggaccggcgcggcccgcgacggtgacctgccgcccgccccggccctgcgccccggtgccctgctgctggtcgaccggcccggcgcggtgcagtcctcgctgcgggtggcgctgccgggcctgccccgcaccgaccccggatacgccgcgctggccctggccaacatgctcttcggcggctatttttcgtcccgctggacggagaacatccgcgaggacaagggctacacctacggcccgcactcggcgatcgagcacttcaccgccggatcggtgctggtcgcggcggccgaggtggccaccggcgtgaccggtccggcgctgctcgagaccacgtacgagctgggccgcctggccagcctcgcgcccggcgaggaggagctcgaacaggcccggcggtacgccctgggcaccctgcggctggggatgtcgacccaggccggcctggccgggctggccagcgtctacgccggcttcggcctgcggctggactacctgcgacagcactcggcggcgctggccgcggtcacccgggagcaggtcgccgaggtggcggccaggcacctggccccgtcccgcgcggtcaccgtggtgctcggcgacgccgagcagatcgagccgcagctggccgccctgagcacggtggagcgcgacccgcggtgaccacccctgagcaacccgacttcggcggcgagcagcccggcactccgccgctggcgcggaccaccctggaccgcgccgcggatcggcgcaaggacgacgcctggctggccgaggcctggacccgcggcctggtgctggtggtcgacctggcccagggcggccgggcgctggtcaccgaccgcggcgacggcggggtcacgctggtcctggtgccgtcggcggccgcgccggacgccgagcactggttcctcggcgtcgacccggacggcacgccgctctggaccatggacgccacgccgccgccggccgagggcgcccgcccggcgaccctgcgggagatcgggcatctgctcgacgaccgtgacgccgggctgttcacggccgccgcggcgctgaccaactggcacgccggccaccggttctcgccgcgcaccggcaagcccacggtggcggtggaggccggctgggcccgcgccgacccggacggcaagctgatgtggccgcgcaccgacccggcgatgatcgtggtggtgcacgacggggtgcccggcccggccggacgctgcctgctcggtcacaactcggcgtggggccgcgccgcggacggcctgacccggttctcctgcctggccggttacgtcgagccgggggagtccgccgaggccgcggtggcccgcgaggtccgcgaggaggtcggcatcggcatcggcgcactgcgctacgagggcagccagtcctggccgtacccgggctcgctgatgctcggcttcctggccgtggccgacccggcgcagccgctgcggctggacccggaggagatcgacgaggcgcactggttctcccgggacgacatcgccaagatgatcgccgggggctacgtgcacccggattcaggggtgccgatgagcctgccgatgcgctcctcgatcgccttttacctgatcgagaaatggctgaccgccggtgccggagatcacggctgaacgtctgaccggaagatttctcgtttcgaggcaacctgggtagcgtcccggtgcgtcatgcttttacaaagacgagaggggatccgatgacccaggtggaagcgccggcgtggacgccgatgtccgcggaggagcgggaggcgttcgaccgcgacggttacatcgtcgtgccgtcggtgctgagtgagagcgagatcgaggccggtcgggccgcgatcctggggtattacgagaaggccaaggaaacgggcgagctcagcgcgaccggtgccctgcaccgcctgtcgccggtgaactacgtgcccgagctggccttcctgctcgaccaccccaaggctttcaagtacatctggtcgctgctcgggtggaacgtgcacgtgtaccactcgcacatcgacgtccacccccagctgcacgagcagcagaagcagtggtggcactggcaccaggacggcggccggcagaaccgggagatcgagaccgacccgcgtccgatgctgtcggtgaagctggcgtactggttctccgacgtcagcgagaccggccggggcaacttcaccgtcctgcccggcagccacaagaccaactggctgcccggcccgccgagccgtggcgtgccgtggccggccccggagggtgccgtccagatcaccgcgaacccgggtgacctggtcgtcttcgaccggcgcatctggcacgcccggtcggacaactactccgacatcacccgtgtcggcgccttcttcggctacaccccgcgctggatcgcgattcgcgacgaggtggccgacctgccgaacaagcccgagtgggcgaccatgaccgaggtgcagaagcagctgctcggcgggttcggcaacggcgacggtgaccaccagtggggtcactacccggcgaccacgccgctgtacggcgagctcaaggagcgcggcctgctcgactcgagcatccccgccctgatcccgtaggttcctgcggaaaagggcccgtccggatggacgggccctttcggtttcccggctcaggcggagagcgtggccaggtgctgcttgacctggacgatggacgggttggtcagcgccgacccatcgtcgaacttcagagtcggcaccgtctggttgccgccgttcacgctgcggacgaaggccgccgacgtctcgtcctgctcgatgtcgaccacctcataggcgatgccctcccggtcgagctgcgacttgaggcggtggcagtacccacaccaggacgtcgagtacatggtcagcatcggactgggctccttcggatacgggtcacacggcactacgccatcccgcacaacgtcccgcgggggtgtcatgattccctaccgtgcggactgaaacggtgctggccgggctcgacccggaacagcggacggcggtgacggcgccggccggcccggtctgcatcctggccggcgccgggaccggcaagacccgggcgatcacccaccggatcgcgcaccggacgctgtccggcgagatcaacccccggcacgtgctggcggtgaccttcaccgcccgggccgccgccgagatgcgctcccgactgaccgcgctcggcgccggcggagtgcaggcccgtaccttccacgcggccgccctgcgccaggtgcgctacttcgcgtcccggctgctggcgggtcgcggcatgccggagctgatggagagcaaggtccgcgtggtcggcctggccgccgcccgggccggggtgcgcgccgaccgcgcggtggcccgggacctggccggcgagatcgagtgggccaagtcgtcgctcgtcgagccgtccgagtacgccgtcgcggcggccaaggcgctccgtgagccgccgttcgagccggcccgggtggcggaggtgttcgcggcctacgagtcgctgaaacgccggcagggagtgatcgacttcgaggacctgctgcgcgccgcggtgtgggggatcgaggaccacccggacgtcgccgaccagatccgcgcacagtaccggcacttcgtcgtcgacgagtaccaggacgtcaacccgctgcagcagcgcctgctggaggcgtggctgggagaccgggacgacctcaccgtggtcggcgacgccagccagacgatctattcgttcaccggggccacctcgtcgtacctgatcgacttcccgcgccgctggcgcagcgccgtcgtggtccggctggtccgcgactaccgctccactccgcaggtggtggggctggccaacgcggtgatccggcaggcccggggcaccgaggcccggttgcgtctggagctggaggggcagcgcccgcccggcccggagccggagctcaaggtgttcccggacgagccgggcgaggcggccgcggtggcccggcggtgccgggagctgatcggctccggcacgccggccagcgagatcgccgtgctcttccggaccaacgcgcagtccgaggcgtacgaggaggcgctggccgaggccgaggtgccgtacgtggtgcgcggcgccgagcggttcttcgagcgggccgaggtgcgccaggcgatggtcgcgctgcgggccgccgtgcgctccattccgggcgagacgccgctggtcgaggcggtcgtcgagggtctggccgcgaccggatggcggcgcggccagccaccgccgggcggcgccgcccgggagcagtgggaggcgctggccgccctggtcgcgctcgccgaggagtacgccgccgagccggccgtgctgccgatcggcgagggtggccgggtgcagcgcgaggtcagcctggccgcgttcaacgaggagctggcccgccggtccgagcagcagcacgcgcccaccgtggcgggcgtgacgctggcctcgctgcacgcggcgaagggcctggagtgggacgcggtcttcctggtcgggctcgccgacggcacgctgcccaccacgtacgcgaagaccaatgagcagttggaggaggaacggcgcctgctatacgtcggggtgacccgggcgcggcagctgctgtggctgtccttcgggcagtcccggtcgccgggtggccgggcccggcgaccgtgccgtttcctgccgcagccggagcgcgccaccgcgggcgccggccggccctcggcggagcggagtcggaaagccgaccggcgcccgccgaaggtgtcctcctgccggatctgcggggccaccctgttggccggcgccgaccggaaactgggccgctgcccgacctgcccgtcggacatggacgaggacctctacgagcgtctgcagcggtggcgggcgagcaccgcggcggagctcaaagttcctgcttacgtcgtcttcaccgacgccaccctggtggccgtggcggaacgtcgtccgaccgatccggcccagttgctggcgatcgccggaatcggcccgcggaagctgggccagtacggcgaggcggtcttcgcgttggtggccggcgccggccctgatgatcttggccgaaaaaactttgaaaactagtgcgttaattcgtttgccctcccctgtagggcaggcatagcctcaggacacaccttgccgggggattgtcccgggcgagatcaaaacacgagtgcggttatacggaggaggtggcaccgatgaggatcaacaccatgctgatgcgtccgtcgatgttgccgtctgccgtctgcgctccatccgctctgctgcccgtcgccgctccgtcggcgctgctggctgccgagcgtgttctggctccgcaggctcaccaggtcttcagccagtcccaggccgagctgggcaaatgggctgtcgagcgggtgctcgcgagcggcgtcaagggcagcactggcatcaatggcaccaccgggttcaagggcaacgattccgtcaagcgctacacggatggaaacggcgtcccgcctcgaggaaggccggtctgacagaccagacctccggctcacctcgaggccgcggaacccctaaccgggatccgcggccttaattttttgccggcccaccaggccggtgcacaaccctgaaaaggcgatccagaagatcgacgaagaagagagaggtgaccgggctttatgagtctggcgctggccccgatcgacatcactgtcgacatcgaggcaaacctgccctgccggaagttcgacccggacctgtggttctccgactccccggcccagctggagctggccaagtcgctctgcggggactgcccgctgcgcgtcgagtgcctggccggtgcggtcgagcggagcgagccctggggtgtctggggcggcgagatcttcgagcgcggcgccgtggtcccgcgcaagcggccgcgtggccgtccccgtaaggccgacgtcgcgcgcgacgccgagctggcggtcgaggtcgaggagcggctcgccgcgaacggtctcgactcccgcaacagcgttcggctggcggcctgagatgaccgacctgaccctccccgagatcgacgaccgaaagccgagcaccgtaaccgtgtatccgaatggagccaccaaagtgagactcatccaagaggcgttgtcccgggctcgaatgcgtcggcctcagagcgacagcgcacctgaggcttaccgttccgcccgccgtatcgccatggaaggccgcaagcaggccgctcgcgatctcggcgtcggcgggtactgatccccacaccgacccgctaccaagggaaatgacgaaaggctcgtccgcatgcggacgagcctttcgtccgtggccggttccggccggctcgggggtcccttgcggatggtggcatccgcgatgcttccccgggcggcgccctccgcagctcccttgcggatggtggcatccgcgatgcttccccgggcggcgccctccgcagctcccttgcggatggtggcatccgcgatgcctccccggacggcgtcctcggggctaccgcgggagtggagaggacggaacatcgatgatgcttgtcacatccgagatgtcgatccgggccgccacggatctgtcggcgtgcccccgccccaggtcgtcgatcgccagccggccgacgacgtcggcgacgccccggtccggttcggccggcatgagccgttggactcttccgccccgcgggtccagcccgaagattctcagcatgcgccggccccgaccatgggcgtcgatcgggatgatcggcgcaacagttgcccgccgcgaaagggtcgtctcgcggccggggtcaggcgatcggggcgaagcccggcagccactcctcgaggatctcctggtaagccgcctcggcctccagctggcagaggacaccgatcgagccgagcgtcacccggtggatcatcaggtacgacgggggcaggttgagtttgcgcccgagctggtatgccggggagcgggggttggccagccgggtcgcctcgccgcgcagccaggtgcgggtgaagcggaaccgctcgaccgcgaccggctcgatcatcgggcgcaggaaggcgagcaccgcctccgcgtcgatcggctcgtcccgtttgatgaaaccctcgtcgcgcagcccgtccgcgaccccctcggcgtcgccgtccagggccagccggaccaaccggccgatcggctccggatggccctccgggagccgggccaccgcgccgaagtcgatcacgccgagccggccgtcgggcagcacccggaagttgcccggatgcgggtcggcgtgcagcagtccggcccgggccggcgcggagaagtgcaggatcgccatcagccggccggcctcgtcccgctcggccacggtgccgccggcgatcacgctggacagcggcgtgccctcgacccactcggtgaccagcacgcgcggcgcggaggcgaccacccgcggcacgaagatgtccgggtcgtcgtggaaggcggcggcgaacgcccgctgggtctccgcctccatctcgtagtcgagctcctcgacgacccgctcgtgcagctcggcgagcagcggcttgatgtcgatcccgggctgaatgatcttgaacatgccggccagccgggacagctgtttcaggtccgcgaccagcgcctcgccggcccccggatactgcaccttgaccgcgaccggcagcagtttcggcttgccgttcttccgggccggcggcagtttccagaccgcgcggtgcacctgaccgatgctggccgccgcggccgggctgtcgtcgaactcggcgaaactctcccgccaatccggtcccagctgctcggcgagcgccttgtgcacgttggccaccggcatcggtggggcggcctcctgcagtttggtcagcgcctgccggtaggggccggccatctcctcgggcagcgcggcctcgaagaccgagagcgcctggccgaacttcatcgcgccgcccttgagctgccccagaacgctgaacagctgctcggcggtgcgctgctgaatgtccgcggagatgacgtcggcagcgatcccgacggcccgcttgcccagtcccagagcggtccggccggcgaagccgagcggcagggcggccagcttggccgtccgggaggccgcacggcggggtatgtccgtcaccagatcattgtgaccgaccgcgcggcgttactcggcccgtcgcgcactgctttgccagtttatgcgacaaaggttcgattaaggatccacacttcctccacactccgcccgtttggggagtcctgtctgggtcgctgcggacggcctcaggtgaatgggggatcgccgcgcccgcgcgccgcaggcgcactccggatgcggcggccacgtccggcggcgggtccgccccggcgcgctgatctccaccgccgcccccagcgtgtccggcgtcccgccgtccaggaaggtcagtgcctcggcggtcgcgaaccccgccgccgccagcacggtcgccaccgcgcacggctccgtcccgcccgggccgccaaccccgcccgtcccgggcaggcccggccactccgggtcccgttcccgccgatgcaggtcgaggcagtgcaggcagggtcggccggcggcgggcacgaacggcccgatcaccgcggcgccgtcccggatgtgcaccgcgaggtgcggctgccggcgggtgctgtgcgcggcggcgagcagcgcgaccggctggtcgtgggcgagctggacgaccaggctggccggtgcgcggcggacctcgcagacctgggtgccgggcacggcccggcggacggcggccgccaccgcggtgtgcagcgggctgcccaggtcggtgccgatcagtgggctgccgggcaggtcggccggccccacggtgccggacagactagctagctagctcggcgctgggcaggccggccgggagcagtgcggactgcggcagcaccaggccggcctggcgcagcaggtcgagcagctggcggggtctcggccggggcgacgcccaggtcggcggcgtgcagcagcacctggcgttccggccggttgccgtcgagcaggtcgagcacccgggccaggcgggggtcgggcagctcgaggcgcaccgcgcgggccgggtcgaggccgagctgcagctcgtcgggagcacgccagatccgggcgagcccggggatcagggtgggccgggcgagtggggcccgggggaggggcgggtgggtcatgggtgacaggttgtcactgccgggctgcggagcggatttgttatccacagcctcgcggttcacccgactgggttatccacaagcggagctgagttatccacagggtgggtacaccggctccggcttactcaacgtgcacgggccgacacggttacggtccgcccgggagggcggcctcgcggccgccttcccggaagcgcacgtctacttggccttgcccagaatccggttcatcgtcgttccgcagaccgggcacttgcccttggccatgttcatgccggtcttggagacctccacgttgccctggaagtcacgcttctccttgcatttgacgcagtagccgttgtaggtggtctcggccacggttcctcctcgttcgtgtcgtcggccgctgggccccgtgcttgttcgcagcgacgggcgcgaacctgttcacggcgctgggccgccggggcgtggaattacccaggtcaggccggttccatgtcagcgcgctgtcggcggtctcaccgacgtggtgagtgtgccggggcgaagtgcccttttcgtacaattttgccgggacacgccgacgattgtcttcacaacggcacgaaagggatgtgcgcccccggtatccccctgagtcgacgatggtctaggttgacggctgtctcagatgttgcgcctggggaaaattttttcgggtatttgcggacgaaccgcccggccaacgtgacagtcattgggcgtactcttgcggtgaccagggtctcgcggattagcgtctcaacgtgaacccgaatctgggccgcgcgagccggtaatggcccgcgtgcgcaaacctgtcgtggaagtgcggcgcagtcagcgccggcgcaggacggtgtccgcgtatcgcgacggcgagcgcgtggtcgtgctcatcccggaccggttctcgcgcgccgaggaaaccgagtgggtcgagcggatgctcgcccgtctcgccgcccgtgaggaacgcctccggcacaccgacgacgagctgctcgcccgcgcccgccggctgaccggacgctacctagcggagtacgccggcctggtcgccccggccagcgttcgctgggtcaccaaccagaacggccgctggggttcctgcaccccggacgacgccaccatccgcatctcgcaccgcatccaggagatgcccgactgggtcgtcgactacgtcctgttgcacgagctggcccatctggtcgtcccgagccacaacgcgcgcttctgggagctggtgaaccgcttccccaaggccgagcgggcccgcggctacctggagggcgtcgccgccgccggctccctcgtcatggccgagtaaacccgccaccccggggtgatccctgcgcaagatccgccataacctccagctctccgagcgcctccggcgattcggccgtacgccgtaaccgccacccaccccgcgcgccgtgcgctccgcctcgcgtcgtcgcccgtcgcctcgcgccatgcccgcctcgcgccatgcccgccttgcgccatgcccgccttgcgccatgcccgccttgcgccatccccgcctcgcgccgtcgcccgccatcgtctgccgcggtgcgccgtgtgccacccgctggccccttggtgagcgggggcggcacagcgtgccctcgctgtcgtgagcgtcgcgggtcggcgaggtgtgccctgggcgctgggtagggtggcgttgtgacgcggcgtgtggtggtggcgatgctggtcccggtgccgtggagcccgcccggggtggatccggcggcctggcgcggcgctctggccgaggacgtcgccgatctgctggcccgcctcgcgcaggccgaggccgcgatcgccgccaccgcgcaggaccgggctctggccgaggagatcgcctggcccggcatgcggatctacgagatcccgcaacccaccgtgctcccggtgctgcgggcggccgccgccgacggcttcgagcaggccgccgtcatcgccgccgacgccccggacgttcccggcatgatcctcggcaagctgctgcgcccgctggagagccgggcggtcgcggtctccccgggcggccccggtggcggcctgctgggcgtggccgccagcctgcccgccccggattggctgcccgaccacgatctcgacacggcctccgcccagtcgctgcgccggtccgccccgtcccccggcgaggtcacctccacaccaccgtggcgtcgcctccgcggcccggccgaccttgccactctggacgtggccttggaaggctgggacaacacccgagccctcctcgacacctgagccggtcaagggcacggaggtggggcggcgccgtcggcgccgccccagcggaagcgttccgggtcggttctacttctcggtgtcgtccgggccggagtgcggagtgtcggtgcccggctccggggcgtccggcccgggctccgggttgccggcgaggccttcgagttcgctgatgtcccagtcggactgggtgcgggcgaaagcctccgggtcggcgaagtcctcgtcggtggggagcaggtcggggtggtcccagagggcgtcccggcccgcggcaccgcgcgcttcggcgaccgccgtccacagggcgccggcctcgcgcaggcggcggggtcgcagctcgaggccgaccagggcggcgaaggtctgctcggccgggccaccggcggcccggcggcggcggaacgcctcgccgagcgccgcgaccgacggcagccggtcgccggccgcctggtcgaccacgtggccgacccagccctcgaccagggccagtgccgtctccaggcgggccaggctggccttctgctgcggggtgtcctccggagtgaagatcccctccagggccatggcctgcatcgactccgggtcgctcgggtcgacgcggcccatcgcctcctcgatcgcctcccggttcacggtgatgccgttggcgtacgtttcgacggcgctcagcacgtgcgcgcgcagccacggcacgtgtccgaagagccgctggtgggccgcctcgcgcagggcgacgtagagccgcacctggtcctcgggcagttccaggccctcgccgtacgccttgatgttggccgggaccagcgccgcggtgccggccgggccgagaggcaggccgatgtcgccggccgagaggacctcggcggcgagctggccgaaggcctggccgagctgaccgccgaaaagcgcgccaccgagcgtggcgaccatcgactgcatcgggccgagctgggcccgggcctcctcgggcacgaggtcgcccatggcgcccaccatgcggccggcgatcggctcgcacagcttcttccagacgtcgagggtgttgtagatccactcgttgcggttccaggcgaccgccttgtggatgccgctggggagcgcgcagaccgggtcgagccacaggtcggcgaggcggagtgcctcctcgacctggtggcgctcgaacatgttcaccgccgggtcgccgctggccgagagctggctggcggcgacctgccgggccaggtcccagttgaccgggccactgccgggggcagcgaacatctgctgcagctgcgccatgaactgctgcatctgctgcgggtcggaggggtcgggcggctgcgcgcccggcagggagaagccgaacgggatatcgggcacggacctaacggtacgcgcgaaacgctcgtagcggactgatggaggtgtcagctcagagagaactcagggtgggtcggtactctcacgcgcatgagacgtcgcggtgtcaccgtcatcctgggcgccctgataaccgccctgctggccgcgggtgtcatggtcgcccccctgccctacgtggtgctcaagcccggcccgacggtgaacaccctcggttcggccgagggcaccgaggtgatccaggtgaccggggccaagacctcgtcctccgccggtgagctgcggctgaccacggtgaacgtgcagtcgcacgtggagctggtctgggcggtgcagggctggctgagtcaccaggacgcggtggtcccgcgtgacctgatctacccgccggaccagagcgagaagcaggtccaggagcagaacgcgcaggagtggaagcagtcgcagaccagcgccgagacggtcgcgctgcgcgagctcggctacccggtgcagacctacgtgcgcaaggtcaccgcgggcggcgccgccgccggcgtgctccaggagaacgacgtgatcacctcggtgaacggcaccgcggtgaccgggccgggccagctcacctcgctggtcaccgcccagccggcgggcagcaggctggccgtggggtacacccgggccggtagggcgggcaccgccgaggtgaccacgaaggccgcggacgacgagaagaagacgccgcgcctggggatcgagatcggcacccagcagccgcacccgttcaccatcaagatcgacctggacaagatcggcggaccgagcgccggcctgatgttcaccctcggcatcatcgacaagctgcgcgacgacgacctgaccggcggcaaggtgatcgccggcaccggcaccatcgacgacgacggcaacgtgggtccgatcggcggcatcccgcagaagctggtcggcgcgagcaaggccggcgccaagatcttcctggtccccaaggacaactgcgcggaggcgctgcgcaacgcggtgcccggcctgccgatggcgaaggtggccaccgtggacgacgcactcaccgcgctcaagaccttcacctcgggtggcacccccacaccctgctcggcatcatgaccactggcagtgaccggacatgttccaccacgtatcgaagctggatacgagatcgtaaggtgagacaccggcccgacgaagtgtggagccaacgttggtaatgcgtaacagtcccctaccgaggatgagccggcgcggtcgcgtcaccgtcggcgtcctggtcggggtcttcatacttttcacgctgctcggctggggcatcgacgcgtacacggactatctctggttctccgaggtcgacttcgccaacgtgttctccggggtgctggtcaccaggctgctgctcttcctgacggtcggcgcggtgctggcactgatcgtcggggcgaacctgtacctggcgtaccggctgcgtccgctgctgcggccgcactccgcggagcaggccacgctggagcggtaccggatggtcctcacgccccggctcggcacctggatcaccgtgctgagtgtcatcatcggattcttcgcgggactgtccgcgcagagccgatgggccgactggatgctgttccgcaacgcgcagccgttcgggcagaccgacccgcagttccacgtcgacatcgggttctacatcttcgactacccgctgctgcgctacctgctcggcctcggcttcaccgcggtggtgctgtcggtgctcggcgcgctcgccgtgcactacatcttcggcggcgtccgactgcagggcgtcggcgaccggatgaccaccgcggcgcgtgcccacctgaccaccctggtcgcggtgttcgtgctgctcaaggcagtggcgtacgttctcgaccggcgcgctctgctgctcgagcagcacgtttcgccggggctgtacggcgccggctacaccgatgtgaacgcgctgctcccggccaaggagatcctggcgtacatctccattgtggtggccgtcgcgatcatcgtgttctccaacgcggtgatgcggaacctggtgtggcccggcgtctcgctggccctgctcggcatctccgcggtcgcgatcggcggcatctacccgctcgccgtgcagaacttccaggtcaagccgagcctctcggacaaggagcggccatacatcgccaaggcgatcgaggccacccgggacgcgttcgacctgaacgccacgaaggtcaccgactacaccccggtgaccgcggcgaacggttccacgccgccgccggccaacctggccgacgacaccagcgcgcagaacgtccggctgatcgacccgcagctggtctcccaggctttcacccagtcgcagcagtcccgcagcttctacgacttcggcgagaagctcgacgtcgaccgctacacgatcgacaacaagacgcaggacttcgtggtcggcgcccgggagatcaacgacgagaagctctccgcacagcagcggaactggctgaaccggcacaccgtctacacccacgggtacggactggtcgccgcgccggccaacaaggtctgcgaaggcgccgggcttccgtacttcgtctccggcttcctcggcagcaacacctcggccaactgctcggcgccgaccgacgagctggaagccacccagccgcggatctactacggtgagcagtccaccgagtacgcgatcgtcggccagaccgacaagagcaggagcgtggagttcgaccgcccgaaggaacgggacaagaacgcgcaggggcaggacgaggacaaagaggcctcggaccccttcacgtacgacggcaagggcggcgtcgcgatcggctcgttcttccgccggctggtgttcgcgatcaagaacaccgagagcaacttcctgctctccgacgcggtcaacgccaactccaaggtgatgtacatccggaccccgcgcgagcgggtggagaaggtggcgccgttcctcaccatcgacggcgacccgtacccggccgtggtcgacggcaagatcgtctggatcctggacggctacacgaccgcccagacctacccgtacgcgcagaagatcaacctggcgaacgagacgcgcgacgagacgaccggggccggagccttcccgctggcccgcgacgacgtcaactacatgcgcaactcggtcaaggcgaccgtcgacgcgtacgacggcaccgtcaagctctacgagttcgacaccaaggatccggtcctcaaggcctggaaccaggccttcggcgggcacctgatcatccccaagggggacaccccggccgatctgatcaagcacttccggtatccggccgacctgttcaaggtgcagcgcaacctgctcaccaggttccacgtccaggacccgcagacgttcttcaccggcgacgacttctggcaggtgccgaacgccccggacgcaccgcaggccggggtcaagcagccgccgttctacctgaacgtcaagctgcccgtgcagtccgcgaccacgttccagctcacctccggggtcaccccgaacggccgggacaacatggccgccctgatctccgcgtcgtacgacaccaccggcgctccgcagctgcaggtgctcaagttgcccaacaactcggtgacacccggccccgtccaggtgcaccggctgatgaccaacaacgcgggcatctcccagcagctgttcgcgctcaaccgcaacggccagaccgtcctctacggcaacctcatctcgttgccactgcaacagggcatcctgtacgtcgagccggtctacgtccgcaccaccgcggccggtgcggcgccgctgctgcagaaggtgctcatgtcgtacggcgacggctccaacgtcgtcctcgagaacaacctgcaggacggcctgaaagccctcgccgccgccggcaagaacaacaacggcgggaccggcaccggcggcaacaccggcacgacaccacccgccagcggcaccggcccgccggtcctcagcggcgacctcgcctccgccgccgcggccgtcgaccaggccatcgagaacctgcggaacgcgcagaaatccggcgacttcgtggcccagggcaacgcgctcaaggccctcgacgacgcgatgagccgcttccagcaggcctcccaggcgaagggcgggacgaccaccggcaccgggccgtcggtcacaccctccaccgccgccaacccggcaccctccgcgagtgcgggcggctgaccagcgaagacgccggctccgggggctgttttgcaggttccggagccggtgcgctaggctttatctaccgacgcggggtggagcagctcggtagctcgctgggctcataacccagaggtcgcaggttcaaatcctgtccccgctacgagggaatgagggactcctgtccgcggaatgcgcggaccggggtccctcttcgcgttgctggccggggggccgagccccccgagcccccgcgttccggtgggcgcggttggtgggtcggtggccggttcccggcgccgagatgggcttggtcggtgggtcggtgaccggtacccgacgccgagacgggcttggagttgcagcgccgtcaagaaccagcccgtgggccggaactggccagaaacctgcgaggtgggttaagcgtgcgctgaaggcctggccgtggggcgggcgtgggctgaaggcctggccgtggggcggacgtgggctcaaggcctggccgtggggcggacgtgggctcaaggcctggccgtggggcgggcgtgggttcaaggcctggccgtgcggcgcggggctgtgcgtggtccgttgtgggtgcggatggtggttaaaggcggctataccgggttcggtggctgtttggggatgaattgattaagggcgacagaacattgaaggacgacttagtgcgggtctatggtgagggccgcgaggggttgtagggggcgattcctccgggttggcggaaggacccttttcatgcgtttgcgtcgcggattgatcatttccggattgttttccgctctgctgctcgctggaacgtcgggtgtccatccggcggccgggcaggcggatgccgggcacctccacggcgacgaggccgacgagatccgcgagcacatggcactcgacctcgccgatacgccgatcagcgagatcgagcgacggaccgcggtgaacgccgcgcggatccagcgggacaccggccaccgcccgggcaccccggtgtcccgggtggccgtttccgccgatcccgggcggtccggctcgtggagtccggtggtcggcacgccggtcgtcccggtcttcgacgcggtgctgccgaacggcaaggtgctcatctgggattcggtcggcgacaacgcggcggagtcgtatccggaccacgatttcacgcgggtgatggtctggaatccggctgacaacacgtacaaaagagttgatctgcaaggagcgaacatcttctgcgcgggtttcgcgcatctcccggacggtgacattctggtcgccggcggaaatgccgactcggcccttgacggaacggtttggacgcatatcttccactggcagaccgagacttggacccggggcgagaacatggcggtcggccggtggtatccggcggttgccgagaccgcgaacggcgaggaggtgatcgtcggcggcggcccgaagacggccgaggtctaccagtcggacggcgccctgcgcccgctcaccgccggcccgacgtacgcggcgcgggtctatccgttcctcggttcccggccggacagccagctccagctgttcggtccgcccaccacctcgtacaccgtcaccacctccggcaacggggtgatcaccgcgaccggcacgcgggacgcggtggcccgcgactacggcgggttcgccacctacgacgtcggcaggacgctggtgaccggcggcggcaacctgaccgagggcggggtcgcgcaggtgcccacgcggacctcggtggtgctgaacaccaccggtgcgggcgccaccgtgaccaccaccggctcactgtccaccgggcggcgccagctcaacaccaccctgctggccgacggctcggtgctggccaccggcgggttgacgagcaccaggaagagcccgctggtcgacctggacagcgcggccaccgcggcggagcgctgggatccggcgaccggggcgtggaccgtgctggccggcgccggccggatccggcagtatcattcgaccgccgcgctgctgcccgacggccgggtgctcaccggcggcggcggggtctgcgggatctgcaccacggtcggctatctggagaagaacatcgagtacttctccccgccctatctttatcgccaggacggcagcggccgccttgccgaccgtccggtgatctccgccgcaccggccggcgtcgacatcgccaccccgttcgcggtgacctccccgcaggcgtcgagcatcaggaaggtggcgctggtcgggctcgccgacgtcacccacggcatcgaccagggacagcggtacatcccgctgaggttcagcgccgccggcaccacgctgaccgtgaccggcccgccgagcggcggtgtcgccccgcccggctactacatgctgttcgtcgtcgacgcggccggtgtgccctcggtggccaaggtggtgaaggtggcccggcagccgaacccgctgatgagcccgatccgcagcgtcaacggcggcgaccgctgcgtcgacgtgcccgcggcggccgtcgcgatccggacgtacctgcaattctacgattgcaacggctccaaggcgcaggctctgacccgggttccggccgacgacacgctgcgggtgatgggcaactgcctggacgtgccgggcggcaatttcgcctccggacagaggatctggacctacacctgcaacggcagcgcctcgcaggcctgggagctcggccccggcggggtgatccggccggtcgggcatccgaccctgtgtctgcgcccggtcaccgccgacaaccaggcggagatccagatcatctcgtgcagtcgcagtctgctgcagaagtggcggtggtgaccggtcacgccggccggtcgccgtgcgggccgtacaggtgcaggatctccgccgggccatcaccggccggcccgaaccagtgcggctcgccggtgtcgaaatcggccacgtccccgggctgcagcaccgactcgacgggcccgcgcagcagccggacggtcccggacagcacgtagaaccaggcgtgtccgggatgggtcaccggggtcggcggacgctgcccggggccgaggatctgtttgaagacctgcaaacggccggggtacgcggtgagcggtaccaccacgctcgggtttccggtgcgcggctcggtgcggtgcggcgtgaggtgcgcccgcggatcgccggtgggcggcgcgccgatcaggtggtcgagcgccatccggtaggtgcgggccagcgggatcagcaggtccagggtcggccgccgcccgcccgattcgagccgggacagggtgctcaccgacaggccggtcgccgcggccagatcggccagggtcagcccacggtcctgccggatcctgcgcaggcgcgagccgatgccgtcgagcagcgtggtcagctcggggtccatcccgacagtttgcggtcttcgcaagtttcctgggaagcgccgggtggttgccgccacgatcggcggcgtgaatgagatgacacgtcgacggctggtcctggccgtctgttgcaccagcatcttcctggtcgggctggacaccacggcggtgaacgtggcgttgcccgcgatcggccgtgacctgcggctcggcctgcccgagctggagtgggcggtcgatgcctacacgctggtgctggccggtctgctgatcggctccggcgcgctggccgaccggatcgggcgccgccgggtgttccggctcggactgatcctcttcggtctcggctcggtcggctgcgcgctggcgccgggcctcggcgcgctgatcgcggcgcgggtcgtgcagggcgtgggtgcctcgatgctgagcccggtggcgctggccatcgtggtgagcgtgatcactgatccgcgcgagcgggcccgggcgatcggggtgtgggccgcggtcttcgggctcagcatggcggccgggccggtactcggcggcgcactggtcaccggactcgggtggcggccgatcttctgggccaacctgccgatcatcgtcgccgtcctggcgtaccccctcccggagtcccgatcaccccggccgcgccggctcgacctgcccggtcaggccctgttgatcgtgctgacgagcacggtcgtcgcggtcctcatcgaagggccgcgggccggctggtggtccggtttcgcgatggcggcgtacgcgatgatccccgccgccgcggccaccctcgcccgggtcgagtcccgccgcgccgaaccgctgctggatctcagcctgttccgccggcccccgttcgccgcggcggtcggcggcgccgtggtggtcttcgtcgcactgaacgtgaccctgctgctcggcacgctctacctgcagcgggcccgcggcctgagcccgatcgaggcgggcctggtcaccctgccgatggcggtcgccgccacgatctgcgccccgctctccgggcgtctggtcggccgggtcggccccggtctgccgctgcgcctggccggagccgggatcctgctcagcggggtgctgctggccggagtggaccgggacaccgggctgccggtcctgctggtggcgtatctgtgcgccgggatcgggatcggtttcgcgaacgcgccgatcaccaacaccgcggtcagcggtctgccgccggagcgttccggggtggccggcgggatcgcatcgaccgcccggcaggtgggggcggcgctcggcatcgcggtggccggtggtctggccggcagcccgcgggccggttgggccctggtcgccggctgcggggtgctgatcctgctgctctcggctatccggccggggtcaggtgctcggccagcacggacagttgcgtcttctgcgcctcggcccagcgttgccggcccgatgcggtgatctgcacgtagacgccccgccggtcggcctcgcagtgggtgcgctcggcgaggccgccgttcaccaggcggctcaccgcccgggacagggcgctctggctcagatacatggtgtccgcaagatcctgcatgcggcgcttgtcacactcctgggtggtgagacggtcgagcgtctcgtagtcactgagggtgaggccgtgggcatcctgcagggctcgctccaggtgcagggccacctcgttgtagcaggtcaggagcgatcgccagcgctcgacgaggtcgttttccggctccatggcgggcatcctactccgcatcggaccttcgatgcacgggaaatatatgcgcccacattcgatgcgtagacattagatgcgtacgcatataacgtcgccaccgtgactatctctgaaaccgtgaccccgacgccgaccgcggccggcggcgcggaacaccgctggacaccgcggctctggggcgtgctggcggtgctgtgcgcggtcctcttcctcgacggcctcgacgtctcgatggtcggcgtggccctgccgtcgatcggcgccgaactcggcctcaccaccacctccctgcagtggatcgtcaacggctacgtgctgggctacggtggcctgctgctgctcggcggccgcaccgccgacctgctcggccgccgccgggtgttcctgatcgcgctcggcgtcttcaccgtcgcctccctgatcggcggtctggtcgacgacggtggcctgctgatcgccacccgcttcatcaagggcctcgccgcggcgttcaccgcgcccaccgcgatgagcatcctgaccacgacgttcgccgagggtccggcccgcaaccgggcgctgtcgatcttcacggtcttcggcgccagcggctactcctccggcctcatcctcggcggcgtcctgaccagcctcggctggcgctggaccttcctggtcccggtcccgctctccctcggcgccctgatcgccgggctgttcctgattccccgcgacgaaccggccaccggcggcggccacgacctgatcggcgccgtcaccctggtcggcggcatgctctccgcggtgtacgcggtggtcaccgccccgcagcgcggcttcgacccgcgtaccgccgcggtgtcgatcctcgccgtcgtcctgctggccgccttcgtcgtcgcggaaacccgggtccggcacccgctggtccggctcagcatcttccggatcggcagcatcgtccgggccaacgccagcatggtggccctgatgggttcctacgtgagcttccagttcatgatgaccctctatctgcaggacgtgctgcactgggccccgttgcggatggccctcgccctgctcccggccggcctgctggtcgccttcagctcacccttcatgggccggctcatcgaccggtacggcaccgcaccactgatcgtcgccgcgatgatctcactgagcgccggctacctctggttcctggccacctccggcagccaccccggctacctgaccaccgtcctgcccacgatgctgctcctcggcggcggcttcgcgttcggcttcagctcgatcatggcccaggccaccgacggcatcgacgacgccgagcagggcctcgcctccggcctggtccaatcctccggccaggtcggcaccgccctggtgctggcggtggtcaccggcctggtcgcctccgccaccagcaccgccgccggtgacttcaccccgttccggcccggcgtgaacctggtcaccggtgtcgccgtcgccggcctcctgctcaacgtcgcggccctggcggtggcgcgtctgcgcacccgcaccccggcgagggccgcctgaccttccggcggcccgaaccgccggcccggccccgcaccttgcgtcaccgcctcgccctgccgggcggcggtgtcaccgtccgcaccgctccggacaggcgggccgggccgggcagcggtaggcggcaggcgcccgccgtcggcccggctggcgcctgccttccctccggccttcctcggcgcttgcccccgtcccgacggcgagtgacccgcatctgcgcgctgacctgcggattttggcgaccggtaacccggttgcgaggggccgggggcaacgcgctaagctttatctaccgacgcggggtggagcagctcggtagctcgctgggctcataacccagaggtcgcaggttcaaatcctgtccccgctaccaaagtaagtgcaggtcagaacgcggttcgtcttcgtgacggaccgcgttttcgattctcccccggaagtgctccggcgagatcccgcggcagccggcaccgtgaaagatccggacgtggtcggcccactctggcggatgaaatgccgcgaacagcgtcataccagtcaaaggcgtcgttaccgttcgaacgtggctatcaatcgaactcgtacagacacgtgcggtgaccgtctccgcgtccgggggtcgttcgccgtggccctggccgggctgctctcgctctccgcggtcgccatcccgcagtcctcggccgcggcgccgccggcaccggtcgcacaccagatcacgggcgtcgcggcccgcccccgcgcggccgtgcccggcgtggacggacgcgtcgcgatgcgaccggatggcaaagtcttcgccaccgtgagtgatgcggcggtgcggcagtggagcacggcgaccggccgccgggtcggaacgccgatcaccggcctcaccggacaggtccacgccatcgagttcagcgaggacggcaagctgctggcggtcgccgacgacggcggcgtggcgctgtgggatgccaccaccgggcagcggtccggatccccgctgatcggtcatgccgggccggtgcgctcggtcgccttcaacgcgggcggccgactgctggccacggccggcgacgacgggacggctcggctgtgggatctggccgatcggcgcctcctgcacgccctgaccgggcaggccggcgcggtgagttcggtggtgttcagccgggacggcaagcgcctcgcgaccacggccgccgacagcaccgtgcggctgtggcaagcggacagcggacgcccgatcggcaaggcgctgatcgtgagcccgggcccggtctatgcgacgagtttcagccccgacggcaaactcctggcggcctccggcggcggcgacgtcgtgcggctctggaacccggccaccggcgaaccggcgggcgagccgatcgtggccggacccgggccggtgtacgccctcacgttcagccgtgggaccaggctgctggccacttcctccggcggggacgacaccgtgcgcctgtgggacacggcgacccgccacccggttgccgccccgctcgccgggcacaccggaccggtgcgcgccatgcgcttcggtccggacgggaaactgctggccaccggcagtgacgacggaaccgtgcggttgtgggacgcggtgaccggacgtgcccacggtgcgccgctggccgggcaccaggggccggtctgggcgttgcggatcagccggaacggcaaacgcctggtcaccgcgggcgcggacggcaaggtccggctgtggcgactgcccagccggaaagcggcctcccctcggcacggccagaaggcggcccggcccgggtcgatccccctcggtgccgcctgaccggacctcgagcggcctgcgcgagtgatcgccggccgccgggaagcagcgtcccggggcaaaaggtcgattcgcaagaaatgcattgctgcgctccggaatgtgggccatcggctcggctgatgaccgcaggccgcaggttccacctcctgtctccgcgacgagtggacggacccttgcccgcgacatgcggacaagggtccttttcgtatcgcctgccgggccgggacccggaccgggcggtggcgtcgcggcgggctcgggtgcgcggcccggtgggggggatccggtccgacctggcggcggtcgatggcatggggttcgaaggccctgccttcaggggagttgtcagccgtggccttccgggaccgtgaacggcgactgtccgaggtcggtgagccgtcactgatcgacggcggtgagctggggctgtcggagagcttgtcgtggcctgagtgaatgctgggtgttgcggcacactcttgtccggacaggggccgccgggccagaatttgggcgagagcggataggcgtcgatgggcgaggcttgacgtgatcgactagcgtgcggcagcgcagccatacgagggggaccgctgtgctgaaacgatcacgtgtgaaggtagagggcagcccgcgtcgcaagtggccgctgtggctgaagatcgtggtgccactgggtgtggtgctcgtcctgggcagtggcggcgccttcgccgctgtcaaggtcgcggagaacaaggtgaacgcggccatccccgatcaccagctgggcggctccgcggctgctccggtgcagcacgccgacatcaagggtgccaagaacatcctgctggcgagcctggacacccgaccgagctggacgaagacgcatcagccgagccacaccgactcgatcatcattttgcacgtgacggcggaccacaagagcgcgtacatgctctccattccgcgtgacctgctggtggacatcccgaagtacaacaacgggaagtatctgaaccgcgagcaccacgacaagatcaatgcggcgttcgccttcggcagcatgggtctcgacggcgacgacgccaccacgcagggcatgacgctgctggccgagacggtgcagaagcagttcggcatcaagccggacgccgctgcggtggtcaactacgacggcttcgtcgacatcctcaagcagatcaaaaaggtctgcctgtacgtcgatgagaacgtcacgtcgatccacatcgggcacaccaaggacggcaagctggcggtcccgttcaagaccacggcggccggcacgaacccccggcacctgtacgtcgatggtgagcaggtcattcccaacacgtacaaaatcggcaatcaatgtcttgatcccacccaggcgctggacttcgcccggcagcgggacctgctctcgccgctgcacgatggcgactacggccggcagcggcaccagcagcagctgctcaaggcgatcctcaagaccgcggtgagccagggcctcgactcgcccaccaagctgcccgggctgctgaccgcggtcggcaaggcgatgaccgtgttccggcagggcatctcgctcgaggactgggttttcggcatgcgcaacctgaacccggacgacatcgtcacgctcaagaccaacggcggcaagttccacgaggtgccgtcgggggtcggctcgtcggagggcctcaccgcggacagcgtcgccatgttcaaggccgccaaggacgacaccctggaggcgttcgtccagacccacccgacctgggtcgccaagacctgaccgtcaggcgaacagggcggcgctggcccgtgcagcgggccagccgaaggcggggcgccggtcgacggggcgggctgtgcccatcactgcgggtccgcgatcgtggctcctgaccgcccgtgcagcgcggtgaggacctgggcgagggcggccgggtggtgcaggatgccgagatgcccgacgacggcgcgccgggcgtgatcctgcagcagcaccggggtggcgtccggcacggcggccagcgaggcggtgtacggcgtgaccatctggtcgtaccgggtgacgatcgtggtgtaccgggtcgacggtggcgggggagcggtccgcagcgcggtcagcaccggggagccgggcagctgctctcgccaggtcgggatcttcgcgtccagccagcggcgcagcccggccgggagccggtgcggccggttcagcagaccgtgcagggtggtgccgccgtaggtgggcgccagcccgaccagcgtgcggaccgtgccggcggccggctcgccgggcaggcaccgggtcaggtaaccggccaggaccgcaccccaggaatggccgaccacgtccacccggtcggcgccggtcgtcgcccggacctcgtcgatgaaggcggccaggtcgagcgcgtgccggtgggtggcggtgacgtccggcccggggcgggcccgccgccagtcgaacgggtagaccgcgcggcccgcgttggccagcagcggggcgagggtgaaccagtcgctggccgagcggccgttggtgccgtgcaccaggatcaccgggatcgtgccggtcgcggcgccggtcgccggggtcagcgcacccggcgggagaccgcgcggatgggcggcgcggtggcgcagggcggcccgccggctgtagtgcacgggcagtggcggcgactccatggtgcggatcttattacgcacgcgaagtgatgtacttttcggcggacattgacctgagcggctattctccgctccgatgacgaatcaaaacgcggccaaaatcaggcaagccggtatatccgggcgaaatacggcgctctctgcggagcagccgtccccgccggtcaaccggccggcgagggatgcgccggccggtaaaccggcccggctcgccaccctggacgcactccggctgatcgccgcgctcgccgtcgccgcctaccacctgacggcgtcctggcgggtcgacgggcggcacaccccggcgtacttcctgccgcacctggcccacgtcaccgtctacggcttcctcggcgtcgagctcttcttcctgatcagtggcttcgtgatcgggatgagcagctggaaccggagcctcggcgacttcttcacctcccgggtcagccggctctacccggcgtactgggccggtgtgctgatcaccacggcggtggtcacgctcgccccgatcaacggcggcgtcccggtctccggaacccccgacctgcgccaggtcgcggcgaacctgaccatgctgcaggagccgctcggtgtcggctcggtcgacacggtgtactggacgctcttcgtcgagctgcgtttctacctgctgttcgcggcgctggtggcggtcgggctgacctaccgccgggtggtgctgttctgcgcggtgtggatgaccgtcgcggcgctgggcccgatgaccggcagccggtgggtgcaggtgctggccgtgccggactacgcgccgtacttcatcgccggcatcgccgcgttcctgatccaccggttcggccggtcctggctgctgttcggcatcgtcgggttcgcctggctggtcagcgtgcagcgggtgatcgaccgggtgaactcgctgcaccccggtttcaccgtgccgacctggccgggcgccgtgatcatcacggtcgcctacgccgtgatgctggccatcgcgctcggctggaccgaccggatccgttgggcctggctgagcaccgcgggcgccctgacctacccgttctacctgctgcaccagcgcctcggctacaccttcatccggcacacctaccaggcgacccacctgcccgtctggctgctggtggcgatcgccatcggcctgctcctgggcctgtcctggctggtgcaccggctgatcgagaagccgctggcggcgcggctgcggtccgggttgcggcagtcgctcaccgagctgcgggtcgcctcggccgccgacgcggccgccggcgcgctgccccggcagacccgggaggggcggctggtccgggccgcccgcgagctcggcggtgaccgatgaggcacttggcggcggactgtacgaaatgcgccgcgctctgctgtgtcgccccggccttcgccaaatcctcggatttcgccgtcaccaagccggccgggcaggcctgccgcaacctgggtgacgacttccgctgcacgatccacgaggtgctgccggagcgcgggttccgcggctgcgtggtcttcgactgcttcggcgccggtcagcggatcacccaggagaccttcggcgggcgggactggcgcggcgccccggagctggccggcgccatgttcgccaccctgccggtgatgcgccggctgcacgagctgctctggctgctgaccgaggcactgaagctgggcgaggcgcgccggctgcacccgaagctggccgcggcccgggacgagatcgagatggtggccgcgcggtccgccgacgagctgcgcggactcgacgtggagccgtaccggcagcgggccgtgccgttgctgcgccgggccagcgagctggcccgcgccggtatcggcggccgccgcccggaccacggcggagcgcagctgatcggccgtggattccggggcgccgacctgcgcggcgcgagtttccgcggcgcgctgctgatcggcgccgacctgcgcggggcggacctgcgccgggccgacttcaccggtgccgatctgcgcggcgccgacctgcgcggggccgacctgaccggcgcactgttcctggccgcgtcacagctgcgcgccgcaatgacggacgacgatcccctctaagctgagccgatgcggcatgtgtcgggcctggtgtggctgtcgacggttctcgggatcgtcggtctgctgctcttcgacttcttcgtccacgtccggcgggcgcacgtgccgaggctgcgtgaggcggcactgtggaccggcgtctacgtcagcatcgcgctgctgttcggcgccgggatctgggtggtcggcgggtccgggatgggccaggagtatttcgccggctacgtcaccgaggaggcgctctcggtcgacaacctgttcgtcttcctgctgctgctcggcagcttccgggtgccccgcgccgaccagcagaaggtgctgctcgtcgggatcgccgtgtcgctggtcgcccgcaccgcgttcatcctggtgggcgccgcgctgatcgactcgttcgcctgggtcttctacctgttcgggctgattctgctgctcaccgccggcaatctggtgcgcgggaaggccgggggcgagcagaccccgccggacaacgtggtgatccggctggcccgccgggtgctgcggaccaccgatacctacgacggcgacaaactggtcacctaccgggacggcaagcggatgctgaccccgatgctgctcgtgatgatcgcgatcggtggcaccgacatcctgttcgcgctcgactcgatcccggccatcttcgggctcacccagaacgtctacctggtcttcaccgcgaccgcgttctccctgctcggcctgcgccagttgtacttcctgatcgacgggctgctggaccgcctggtgtacctgtcgtacgggctgtccgcgatcctcgccctgatcggggtcaagctgatcctgcacgccctgcaccggaacaacgtgccgttcatcaacgccggtgagcacatcggggtcaccgagattcccaccggcgcctcgcttgccatcatcgtcggggtgctgctggtcaccgtggtggcatcgctgctcagtccacgcggccgggcgcagacgtactcggcggcggcccggcggcgcgccaccgagttcctcgagatcgagaaggatccggcctactgcgacgaggtgtaccacctgcttctcgacgaggagcggaacctgcagagcctgccggcgcggtaccggcagcacggcgacctgaccgacctgctgcgccgggcgcaccgggtgcacgccgagcgggtggcggccggccgctgctacgtacggcccgagccgtctgcggcctgaccctagctagctaggcagcgtcgggcggccagagcccctcagcggccggacgcggcgtcgtccggacggttcaggtaggacgacaggttggcggtccgcccgaacgggtcctcgtcggtgccggcgaccagaccggcgatccgggcggccaggctggacgcgcgcgaggcgaggtcgggctgggcctgccgggaatcctgctcggcgcgcaacgcctgctcggcgcgctcggcgtcggcggccagtccgggccgctcgccgtacccgcgggaggcggagatcggcatcccggagaccggctgctgataggccggctcctgacggacgggctcctcgtacaccggctcccggtagaccggctcctcgtacgccggctcgtcgtagacggcctcggcgtagatcggctcggggtaggcgggctccggggcgggcaccgggaccgcgcccagcagcgtcaccgtctgccccgcaccgccctgatagttggtgaactcgggcccgatcacctgacgcgacagcatccgcgcgtgcgccggcgccaccccgatctccgtggcgttctccacccggaaccgggcgatcgcctgacgcagcacgttggccagacggtccgcgtcgcccaccgtggccaggtcgccgccggcgaacaccagggccgggaaactgccctccggcccgttgcagaccagctggatctgggtcaccgtggcggtgcggccggcgtcccggttgcccggctgcacacgcaggtgctgcggccagagccagaacaactcgccattacgcaccgtgctctcgtccgcatacgtatagcgaacccggcggtccgtgaccaggacctcggtctcttccggcagggtccagcgcggtagcgaggacgcctcgtcgaacgcgtactccgcggccgcgcagcggcctttccagagcacccgctcgccgctgtccagcggtccgaggtcggtgcccggagcggacaggaagtgctggtggaacatggttgccttccccgttcacgccgcagcgggatgatcgcggccaaacgattacagccttgtcctaccagtgtcgccagcgacccgacgcgaatcacaccggaacttgcgaaagtgacaccggacggtaatgaccgatgaaccatcggccgaccgatccgttactttcggttatcgaacaggccggccgggggcaggggtgacgctgtcgcggtggcgtccggcaccgggaccgccccggccgcgaatcgctccaggtcggtctccacccgcccggggaaccagtcgcccgcggctcgccgggtcagctcggccaccgggggtggggtgcgaccggcgagcaccaccagattgccgaacctgcggccgcgcagcaccgacgcgtcggcaaccagacaggcctggggcaacaccgaccggatcgtggcgacctgggcgcgggcgtgccgcagcggcgggccgtcggcgatgttggcgatcagccagccgtccgtggccagcacccgggccacctgcgcggcgaattcggccgaggccagatgggccggggtgcgggcgccggcgaacacgtccagcacgatcacgtcgtacccgccgtcgcgcatgccctcgacagcctcgcgcgcgtcacccacccggacccggatgttcgcctgcgcggggagcggcagctcccggcggaccagctcgaccagcggcccgtcgatctcgaccacccgctgcgccgaaccgggccgggtggcggccagatagcgcggcagggtcagcgcgccgccacccagatgcagcgcgcgcagcggccggcccggggcggccaccaggtcgatcgccgcggcgatccgccgcacgtactcgaactgcaggtacgccgggtcggccaggtccacgtgcgactgcggcgcgccgtccagcagcagggtgaacgcggtgtcccggtccgggtccggaaccagctccgcgacgcccgaggcgaccgtctccacccgccgtcgcgatgccctgcgctgtgccatccgaccattgtccggggagcagcttggtagcgcggagcggggaacgcgatggtggcgcgggaaacttccgactgttcctccgtgacagttgccgagcagaccctgaaccggcgtaccgcgatcggcggtgcggtcgcggccggcgccgccgccgcgctcaccacgggtacgcccgccctggcctcctccaccgccggccccggcctgcgcaccgcggtcgaaccgggtgtggtgatcgaggacccgggcgtcgccgggctccttcccgccgaccccctgctgcacctgctgcggcgggccaccttcgggcccggcccggaatccatcgccgagatccgcaggctgggcgcgaccgcctggctggaccggcagctcgaccccggctcgatcgacgacccggtcgccgacgagctgatctcccggctgccgctgtgcgggctgagcatcaccgacatccacgcccgggtcaccgccggacagctgaagctgcacgactggacgccgatgtggcagctgtcgttcgcggcgccgatccgggccatctggagcaggcggcagctgttcgaggtgatggtggacttctggtcgaaccacctcaacgtgacctgcccgtccggcgacgtgtgggacagccgcaccgactacgaccgggcggtgatccgcaggtacgccctgggcagcttcgccgacctgctcaaggcctcggcccggcacccggcgatgctcacctacctggacaaccggttctccacccggcaggcgccgaacgagaactacggccgggaactgctggagctgcacaccgtcggactgggctacaccgaggcggacgtcaaggacgcggcgaagctgctcagcgggatgaccgtggacaacaccaccggcgcctaccggtacgacgcggccaaccacgtgaccggcccggtgcggatcctggggttcagccacgccaacgccaccaccaccggcggcgaggcggcgaccctggccttcctcgactacctggcgctgcacccgtccaccgcccgccggatcgtcaccaaactgtgcgtccggttcgtcgccgacgagccgtcgcccgacctggtcaccaaactggtcaaggtctatctggacagccggtcggcgatcgcgccggtgctgcgggcgctgttcaccgcgcccgagttcgccgcggcgatcggggcgaagacccgcaccccgctggaggacctggcggccacggtgcggatcctcgggtacggaccgccgccgagcgggaccaagtcgttcgagtcgatctactggatggcccgcaacgccggtcacgccccgctgctctggggaccgccgaacggctacccggatgtcgccgccgcctgggcgtccccgtccggcctgctggtgcggtggaacttccacctgtcgctggccgccggttactggccgaccgacctggtcaagccggccgacctgctgaccgcgatgatcggtgcccggccggccacctaccaggcgctgatcgacgcgaccgcggagcgactgctcggggtgcggctcggccccgaccagaccgccgcgctggccgccttctacggcaagacaccggcctcgccactgaagtacaacgatcccgcggtgggctggatgtacccgtacctgatgacgatgctgctgaactcgcccaatttcgccctgagatgaggacgactgtgacctgccgagagaccctctcccgccgccggctgctggccgccggggccgcgggcgcgttcgccgggctggccggctcgcagctcgacacccagctcgccttcgccgccgacccggcctactccggtgacgtgctggtgctgctctcgctgcgcggcggcttcgacgggctgtccgcggtggtaccggccggcgacccggcctactacaccgcccggcccaccatcggggtgccgaagagccagctgatcggcgccggatcgttcttcgggctgcacccggcgctggctccgctgctgccgttctggaactcgggccggttggcggcgatccaggcggtcggccagccggccccgaaccggtcgcacttctccgccatggaggagctggagcgggccgccccgggcacctcgctgcgcaccggctggctcaaccggatgctcggcaccctgcacgccggcgaccccttcgacgcgatcgcgatgggtaccgcgcgcccggcccgggtgctcgccggcccggcgccgtacctcggggtcacctcggtggacgggctcgcgctctccggcgacgacgccaccaagccgctcgcggccaccatggcggcgctctaccgcggcgcgccggccgggctgaccggcccggtcaaccagctcaccggggcgctggcccgggccaaggcgttgaaggcggccgggtacacgccggccaacggcgccgtctacccggccaccgacctgggtggggcgctgcgcgacgtggcccggctgatcaaggcgcgggccgggctgatgaccgccacggtcgactccggcgactgggacatgcacgagaacctcggcatcgcccagaccggccggcggatgcacgaccagctggcccagctggccgcggcgatcgcggcgttcgccaccgacctcggcgcggacggcctgcgccgggtcaccctgatcacgatcagcgagttcggccggcgggtggcgcagaacggctcggccggcctggaccacgggtacggcaacgcgatgttcgtgctcggcggcggggtgcgcggcgggcaggtctacggcacctggcccgggttgagcccggcccagctctgcgacggcgacctggcggtgaccaccgactaccgggcggtgatcggcgagatcctccggacccgctgcggggtgggcgacgtggcctcggtcttcccgggcgtgacgccgtcctcactggggctggtttccggcattaccggataaagttcggataaggctgtttcacactgtcaccaacgcttcgacccacggaggtgacggtgaccagcaacctgttggccgagctcatcggcgggcaacggcgcccgcccgggccgccgccggccatcgcgatgccggcgatcctgcatgcggccaagcaccgggccgggccaccgctgaagatccgccggcacacctccgaggagggcctgccgttctggcgctgggactgcgacagctgcggggagtacggcggcggccggcaccatccggacgccgtcagccgcgccatgcggcactgctcggagcacccgcagcaccgctcgtcgctgctcccgcccgcgtcgtgccgcaagccggacacgttcctgccgttgcaccccatgctgtacgccctcgacgacgacccgccgccggagccgctgaacatctgagcagagcgggcccggctcaccgagccgggcccgcgtcgcgctcagggctgggtgtcgccggccccggtccgcttctgcgcctcgttcaccccgcggtcgatctgctcggagtacttgtcgccggtccgctggtcgatctgctcgccggccttctccagaccctggtcgacctgctcgtcgtgctggtcggcgaattccttggccttgtccaggaagctcatggcgtggtcccttccgtcaatctctgacctgtctcggccttccgcttacccagaatcccggcaaccttgcggaagatcggatccttcaccacctcggacaggtccggaccgagcgggatccgccagttggggtactcgtcgaaggttcccggcaggttcggctgccgacgttccagcagcacgtcgtagagcgacgcggtgaccagccggcacggggtgcgggccaggaactcgtgcatggccagcaccacctcctcgctggtcgggtccgtgccggtcaggccctcggcgcgcagcagctccagcagcgcggccttgtccgccttccaggtcgcccactcctgctcgacggtgccggccagctgccccagccgggcgcggacctccacctgctcgccggccaggaacccggcggcggtcggcaggtcgtgggtggagatgctggccagcgcgttgcgccggtagtcggccgcgggccggaactcgccggtgtcccagtcccgggtgaaccacagcacggacgagccgagcatgttcatccgttccagcgtctcggtcatctccggcagcacggtgcccaggtcctcaccgatcaccacggcgccggcgcgctgcgcctccagggccaggatgccgagcatcgcctccgggtcgtagtgcacgtaggtgccctcggccggacccatgcccggtggcacccaccacagccgccacagcccggcgacgtggtcgacgcgcagcccgccggcgtgccggaagatccggcgcagcatgtcccgataggcggcgtagccggtggcgatcagccggtccgggcgccaggcggccagcccccagtcctggccgagctggttgaacgcgtccggcggcgcgccggcccggacgccgggtgccagcgagtcctgcagcagccagccgtcggcgccggtcgggtcgatgccgacggccaggtcgtggacgatgccgaccggcatcccggcggccgcttcccgggcccggtccagctgctcctcgaccaggtgctggacccaggcgtggaaggcgatccggtcgctgcggaaggcccgcaccgcgggggagccggggtggcgcagctcttccggccaggtctgccagttcgggccgtgctgttcggcgagtgcgcagaagcgggcgaaatccgtcaggcccggatcggcgtccaggtcgacgggctccgcgagcggccagaggagttccagggcggcgagtttcgcggtccacaccgcggtgtagtcgatcagttcgccggtctccggtttaagggcatcaatgcgcttctgtacgtcgacatccgcgcgctgatactcccgggtgtccgcgatccgcaggtagagcgagttcgcgaagcgccggctggacggcgagtacggcgaggccggcaccggcggcaccggcgtgatcgcgtgcagcgggttgagcagcaccagcccggcgtccccgcactgggacacgaaggcccgcaggtcgcccaggtcgccgatgccccacgactcggccgagtgcagcgcgtacagctgcagcatccagccccaggtgaccggcgccttcggcagctcggccgggaccaccacgacggtggtgcggtcgccgagccggtgccagcccagcggcagcccggccagccggtcgacggtgcgcgtggtcccgtcctccagggtgagctcggcggccgccggcaggtcccggctctgcccctcgcgcagcacgatggtcccggggacctccggcgcggtgacctccggcacggccgccgggtcgcccgcgtcgacgccgagcaggcccagcaccccgatcaccgactcgggggccacctcggtccgcttgcgctggtagttctcgtaccaggtggccaccccgtgtgccgcggccagcgcctcgagtcgcgcgtccatgcgtttccctcccgtcggtccccggtcagtacccggctgatcggtggttactccgggtgcggtcgttgcttccatccgccagcatggggcacatggctcacatggtgaagtggtggacccggctggccgcggtggtgtccggcgcgatgctgaccctggtgatcccggtgcacgcctgggcggccggcaacgggacgtccgaggtggcggtcgaggcggcccgccgccgctaccggacccgaggcggtttcgggttcctcttcggtggtgggctgtgctgcctgttcgtgattgccgcgatcgtgttggtgatcgtgttgatttcgcggaatcgcaagcgccgctgacggatcttgcctagtttgggagaatgcggacgcggagtaggcgatcggtggcagtcggttgcgggatcgcggccgtcctcagcattccgccggcgatctcggtcgccgcgaacgcctccgccgacgtgctgctcagcatcggccgcccggccctcgcctcgtcgacgctgagcgtggcctggctggcctccgccggggtggaccggggcgtcggcacccgatgggccagcggcgccaccgacggcaccgaatggctgcgggtcgacctgggcgccgcgcaggaggtcacccgggtccggctgcactgggcgcaggcgtacgcccggggctatcgggtgcaactctccgacgacggggcgacctggaccgacatgtaccggaccgaggccggcgacggcggcgtcgacgacctgcgcggcctgcacgggcacgggcgctacctgcgggtgctggccacccggcagggcaccccgaacggatattcgttgtgggacgtgcgggcgtacgggccgggcccgtacgcccgggtgcccgagtccggtgcgacaccgggcgccggggtgccgccggccgcggccgcgctgaccgcccacgccaagaaggagaccgcgttccagctcgtctccagcgcggagaactcgacgctgaactggcgcggcgagtacggctacctggaggatctgggcgacggccggggatacaccggcgggatcatcggcttctgctcgggcaccgacgacatgctggccgtggtcgccgactacgtgcgccgcaagccgtcgaacgtgctcgcgccgtatctgccggcgctgcgcggggtggacggcaccgactcgcaccggggcctggacccgggcttcccggccgcctggcgggcggccgcgaaggacccggtgttccagaagacccagcaggacgcccgggaccggatgtacttcaccccggccgtgcacctcgccgagtcggacgggctgcgggcgctggggcagttcgcgtactacgacgcggcggtgatgcacgggatctccgggctgcgggccatccgcgagcgggcggtccgggcccggagcacaccgtctcagggtggggacgagatcagctacctggaggccttcctggactcccgggacgtcgagatgcgccaggaggcggcgcacagcgacaccacccgggtcgacaccgcgcagcgggtcttcctgaaaggcagcaacctcgatctcgacacgccgctgacctggaaggtctacggcgacagctacaagatcagctcttgacccacttctggttcgcggtgccggcgcagtcccagagctggagctgagcgccgttcgcgcggttgttgtccttgatgtcgacacaccggttcgccgacacgtcgaccaggtcgccggcgccggacagggtgaaccgctgcaccgggttgccgttgcaggcgaccagctggatcggggtgccgttggtcagcgcgccgccggccgggtccatgcacttgccgagcgcccgcagcgtgccgtcactgttgaaggtccacttctgcgcgccggtgccgttgcagtcgtacatctgcaggcgcgcgccgtcgaccgggttggacccggggatgtcgatgcagcggccgttcaggttgctcctcagcgcgttgccggtggtggccggcggcgtggtcggcgtggtcgaggtgctcacgtgcacgtagtcgatcagcatcctgctctcggccggcagcccggccgggttgccctggccgaagttgccgccgaccgccaggttgaggatgacgaagaacgggtgctcgtagacccagttcacgttgcccttggcggcgtgcagcgagtccggggtggcccggaagtactcctggccgtccacggtccagacgatcaggttcggcgaccagtccaccgcgtagttgtggaacgcctggtaccacggcgcgccggcgagaagctggccgccgtacgagctgccgccggagtagccggggccgtgcagggtgccgaacagccggttcgggtcgcggccgacgacctccatgatgtcgatctcgccgtcggtcggccagttgttgccgcccagcatccagaaggcgggccacaggccggagccgttgggcacctggatccgggcctcgacgtgcccgtactgctgggtgaacttgccggcggtctggatccggccggaggtgaactggcaggtgccgttccagcagtcgttgtgtccgccgctgcccttgcgggcggtgatcaccaggtggccctggccgtccatcgcgacgttgccggttccgctggtgtagtactccagttcctggttgccgaagccgctgccgccggtgtcgaagttccaccgggacgtgtcgacgccggtgccggccgcgccgttgaagtcctcgttccagacgaccgcggcgtccgcattgtcgttgcgggacgagacgtagagcgaggacgcgagcgtggtggcgactatcgccgcaccgagcaacattcgtaacttgcgcatgggggcctccggggggagagggtgccgttactccaaacagtctttagagatggactgtcgtgggtcaatggagacgggttccggaaccccggaataacaacaaacttttaaactttttcgaagagcgccggtacgagcccgggctgccaccccggcagggccgtgtgctgcgccttcacccggtagttggcgccccggtaactcacctgatcgccgatgcggtaggtggtgaacggcttccagcccggcttcagcgtcacccgcaccgacacgctcaccgagtcgaccacgatcgcgtccgagtaccgcccgccgccgccgaggttcagcgccagccggaacggctgcccggcgtcgtccggggtgagccgcagcacctgggcgccgtcgatcgaccagacgaacgacgtgcgggtccagtcgatcgcgtaggtgtggaaatccccgtcggcggtgtcccggtcgccgagcgactcggcctgcccggagatcccgccgccgtccggccccagcaccccgagcgcctgccaggcggcgccccaccggccggtccggatccgcgccgatgcgtgcccgccggactgaccgaaagtcgccgcggtcagcagccacgagccgaccacggcgtgcccgtcaccgtccagccaggcgtcccgggtgtcgcccacccaccggcccgcgtcgaccggggcgaaccggtcaccgccgaagccgtcgctgaacacggtgctgctgaccgtcgacgcgtgcgcgaccccgggcacggtcagcccgccggcggcgaccacggccgccagcaacggccgcagccagcgcaccccgtgacccatcttcgccctacccccacctcgtgtccgcacagactctgcacgggccgggccggtaagggcaagatcgacgctgagtgaccggggtcagtccagctcgtgggtctcgtgcatggcgagctcctcggcgctggcaccaccgccggccgcgcccgcgtcccacgccacgctgtccgcctcgtcgtcgaagccggacccgccgtccggggcgaccagccggcccacccggcccgggctgtcgtcgtcgagctggccgtcgtcgtagagcgagaccggggaatccgggtccgaggtcgggctctccccccagacgtcccggtccagccggcgctgctcggggtcgtcgaccgtctcgtcgatcgggtcgcggtccgccccgccggtgtccccggcgccgaagtccggctcctcctggcgcagccgccggtccagcccctcgccctgcagggcctcctccgcggtgtcgccgaaccggttcgagccgcccgggccgaccccggcgagcgccgccgggtccgggccgtcggcccatcggccgctgtccacctcgtcgtacgcggtggagtcgtcgtcggcggtgtccggcaggcccgaggcctccggatcgctcacttcggtggggtagtcgttgtctcgcatgtgcgcaatgtacccgcgtgtcggctggtcataccgtgatccgttacgcgttcagatgggcccagacgaccttgccgtcaggcagcgccagccggccccagcggaccgccaccgcatcgatcaggagcaggccccggccgccgtacgcggtgggggcgaccggcccggtgaacgccggcagcaccggcgagccgtcccggaccgcgatgctcaccgtctcgccgagccgggccagcagcacccgcatcggggtgcggacgtgcgccaccacgttgttcaccatctcggtggccacgatgcacgcgtccccggccagctcggcccgcgaccagcgcaggcaggtctcggtgatcagctcccgggcccggcgcgcggccccgctcaccggttccaggtccaggctgacccgcagcccggcgccgggcgtgccgagggccgcgaaggcgctctccgggtcgggccagaccggccagccggccggctgccacagcgggctctgcgcgccgcagagcgcgagccgcgcggccggccagtcccgggtctcctcgcgcagcgcgcgcagcgtgtccagggcctcctcgcggggcggctgcaggccggtcacgtcgaccacgaccgcctccggctgaccggcgagcacgtcgagcagggtggagcggaccgacccggaggtccgtgcgtcgagcaccccggtcagccggaccaggggataactctggccgcggtccaccagctgacgaacctcgctcggcatgatcgctccattgtgcatagcgcgtctccgccgcgcatgtcggcgacggcggatccggacatttgcccacgacgggcatgcatgggaagtaccccgtgcgaggatggtcaaccccggggggtcagagcggtgagcaggctttcgtgcagcaggccattggtggcgatcaccgacgacttgtcggagcagacccgtccgtcgagatcggtgaccttgccaccagcctcggtgatgatcgggatcagcgcggccatgtcccacagtgacagttccggctcggccatcgcgtccagcgcgccctcggccagcagcatgtagccgtagaagtcgccgtacgcccggctgcgccataccccgagcagcacgtccagcatctgcggcagccggccgttcgcctgccagccgttcaggctggcgtaacagacgctggcgtcggcgagccggcgcacctgggagacgccgatccgggtcgcggcgtgctgatgcctcccggcgaaggcgcccaggccgcgcgccgcccaccagcgccggcccagcgccggggcggagaccaggccgaccaccggggtgtcgccctccatcagcgcgatcagggtggcccagatcggcaccccgcgcacgtagttcttggtgccgtcgatcgggtcgatcacccagtgccgggtgcccgggccggccgccgcctcggaccgcccgaactcctcgcccagcacgctgtcccgcggccgggcccgggccagggtcgcccgaatcgccttctccaccgcggtgtccgcgtcggacaccggcgtcagatccggcttggcctccaccttcaggtcgagcgcccggaatcgggccatcgagatggagtcggccgcgtcagcgagggtgtgggcaagagcgaggtcgtcggtgtggatggcgtcgcctccggctccgcggcatcgcgccctccgacgctgacgtcgagcgacctgacaacgccctcgcttcgctagccgttgtgaggccgctcgacgtcagcggacgcgatgcgtggtggtcaatgtctgcgccaggtcactcgtcggccgggtgatctcgcgagtccagatcgccggctcttgaggacagcaggcggcggtacgagtctaaccgccgccggtccgcgcgcccctcgccgacccacgcgtcgagcctgcagtccgtgtcggcggcggtgtgcccgcagttcggctggtcctccagggtgccctcgaccaggtcggggaagccgtgcagcaggctctccgcgctgacgtgggcgagcccgaagctgcggatgcccggggtgtcgatgatccaccccggatccttgcgcgacctgccgacggccggcaggcgcagcgccaccgcgctggtcgaggtgtgccggcccttgcccaccgcgctgaccgcgccgaccgcccgcaacgcgtccggcaccaggcggttgaccagcgtcgacttgcccaccccggagtgcccgaccagcaccgagatgcgcccggccagccgctcgcgcagctcggccaggtcactgcccgggcgcaccagcacgtgcggcaggtccagctcggcgtagtagtcgagcacctgctccgggccggacaggtcggccttggtcaggcagagcagcggctcgatgtcggcgtcgtacgcggcgaccaggcagcggtcgatgaatccggtgcgcggtggcgggtcggccagcgcgctgacgatcaccagctggtcggcgttggccaccacgacccgctccagccgcccctcgggcgtggtgtcgtcgtcgtccgcggtgcggcgcagcaccgaggtgcgctcgccgatccggacgatccgggccagcgacccggcgtcgccggaggtgtcgccgaccagggccacccgatcgcccaccaccaccgacttgcggcccagctcgcgggcccgcatcgcggtgatcacctcggggtcggccccggtgtcctcctggacacacccgtaccgcccgcggtcgacggtgatcaccagcgcgtccaccgcgtcgtcgtgcttgggacgcgtccgggtgcgcgggcgcgacgaccgccccggccgcacccgcacgtcgtcctcgtcgtactcccgcttacgccctggcagaactaactccctgtcgtgagtcccgcccagagttccgggaactcgggcaacgtcttcgacgtacaacctacgtcggtgagctgaacgcccgggacggagagtccgatcaccgcggcggcgtgcgccatccggtggtcggcgtaggtctcgaacgaggccccgtgcagcggccgcggctcgatccgcagcccgtccgggaactcggtcaccccggcgccgacccggcccagctcggtggcgagcgccgcgatccggtcggtctcgtggccccggatgtgctcgacgccgcgcagctcggacggcccgtcggcgagcaccgcgagggcggacagcaccggggtcatctcggccacctcggacaggtcggcggtgatcccgtgcagcgtgccggtgccacgcacggtcagcccgtccgccgatcgggtgacctcgccgccgaacgcggtgagcaggtcggtcagctgcccgaccggctgccagctctgcgccggccagccggccagggtgaccgtgccgccggtgaccagggcggcggcgaagaacggcagcgcgccggagaggtcgggctcgatcacccaggtgcgcccgtgcagcgggccgggctcgaccacccagacgtccggcacgctctcgtcgacgacggcgccggccgcgcgcagcatgtgcgtggtcatccgcaggtgcggggcggacgggaccggcgggccctcgtgccgcagggtcagccccttggtgaaccgggcggcggacagcagcaggccggagacgaactggctggagccggaggcatcgaccaccgccgcgccgccctcgatgagcccggcgccgtgcacggtgagcggcagcccaccggtcggcgacgcgtccagccgcaccccgagggcgcgcagcgcgtcgaggatcgggcccatcggccggttgcgcgcgtgcgggtcgccgtcgaactcgacggtgccctcggccagcgccgcgaccggtggcaggaaccgcatgatcgtgccggccaggcccacgtcgatccgggccgggccggtcagcgggcccggctcgacccgccagctgtcgccgcccgaggtgtccacggccaccccgagcgcgcccagggcggtcgccatcagcgtggtgtcccgcgcccgcagtggcgcctcgatcaccgacggaccgtcggccagcgcggcgagcaccagcgcgcgggcggtcatcgacttcgagccgggcaggcgcacggtggtggtgaccgggccggcggcggacggggcgagccaggggcggagttcagcagccatggaggccattctgccgccgcccgccgacatttccggcgcgcgttcccgcctcccgggacgcggcgagcgattctcgccgggtgatcgttgcgactccaccatttccacggcgttccgggtccgcggccaccgtttccaccggcgtacgctgcgtctcatgtgcggccgctatgccacgacgcggaccaacgcggatctcagccggttcttcgaggcggtcgacctggccggcgagctgtcgccgagctggaacgtggcgcccaccgacccggtgccgctgatccgcgagtcggtcacgcatgccgcccgggtgctcggcaccgcccgctggggcctggtcccgccgtgggccaccgacccccggcagggtgctcggatgatcaacgcgcgggccgagacggtggccacgctgaaggcgttcgccccgtccttcgcccgccggcgctgcctggtcccggccgacggctggttcgagtgggtccgcgacggcaagcgtcggcaggcgttctacctgaccccggcggacggctccccgctcgcgctggccgggatctggtccgcctggggccccgagccgatgctcacctgcagcgtgatcaccaccgcggcgctcggcccgctggccgcggtgcacgaccggatgccgctgatcctgccgcccgagcggtgggcggactggctggccggcggtggcgatccggagccgctgctgcggccgccggccacgccggtattggccggcatcgaggtgcgcccggtcggcccggcggtcggcaatgtgcgcaacaacggcccggagttgctgactccgccggccgaggtgacgcttttctgaactcaggaagatcaacgaagttctttgtcggagtatgcacgcatttccggcggagaactttgcgcgaacatagatcacccccttgttctgatcttgtaccgtgcggtacaaaccagcgccggagtggtttcgtccgcaaggtgcggaacgggcgccacagcagttccggtcccacgggggaggtgggctgatgacacgagcacgcatgccgcgtccgcacgaggtggccatcgcgcgacgtgacccgcggctgctcgaggcgatagcgcaacgccggaccgacgaggcgtggcgcacacggggagcctgccggaccgttgatccggaaacgttctttcccgcgccgaacgagccgtccggtggtgcggtcgcactctgcggcacctgtccggtgcagggcccgtgcctggcctgggcactacaggtcggcgactgccacggcgtctggggcggcaccacgccccgcgagcggcgggccatgctggtcgcctggcgcgagcgggtccagccggacggcgagccggtcgacgacggcgccacggacgacgaggaccgccggttcctgacgttggaacccgccagccgctgacagaatcggagcttgtgtccagctccgagcacatcgtcgaaacgccgcgcgggccggcccgggtccggatcaccggcccggccggcccggcgcgcgcccagctgttcctcgggcacggggccggtggtggcgtggacgcgcccgatctggtcgccgtgcacgacgccgcggtcgcggccggggtgcgcgtgcttctggtgacccagccctaccgggtggccggacggcgggcgccggcccccgccgggcacctcgacgaggggtgggccgcggtggtgcgggcccacggcgtacccggaattcccctgatcgtgggcgggcgcagcagcggagcgcgggtcgcgtcgcggaccgcggccgacctgggcgccgcgggggtgctggccctggccttcccgctgcacccgccgggcaggccggagaagagccgggcggcggagctgccggccgggatccccacgctggtggtcaacggcgaccgggacccgttcggggtgcccgggccgggcggcgcggtggaggtcgtggtgcggcccggtgcggtgcacgacctgcgcaaggatcttccgggcaccgtggcggccgtgctcgggtggcttgcacgacacggctgggccgcggaattctgagcgggccgccggcgttgcacaccccggaagaacaatggcggaaggggtgtcagtggtgcgtaccggtaccgagcgcgggatgcgcgagcgccgggaggcgacccgggtgcgggaacttctggatgctccggagtggccggccaccgagccggcgcccgccgccgccccggtgagcgtgagcacaccggttttcgagagcgtgactggggcactacccgtatcctcggcggggcggtcgaggggggagtccagggtggcccagaaagagcgtgtcgacgagcgtcgcgagcgcttcgagcgcgacgcgctgccgttcgtggatcagttgtacgccgccggcctgcgcatgacgcgcaatccggccgacgccgaggacctggtgcaggagacgttcctcaaggcgttctccgccttccaccagttcgaggagggcaccaacctcaaggcctggctgtaccggatcctgaccaacacctacatcaactcgtaccggcgcaagcagcggcagccgctgcagtcgccgaccgaggagatcaccgactggcagctcgcctccagcgagtcgcacacctcgaccggactgcgctcggcggagaccgaggcgctcgaccggctcccggacagcgacatcaaggaagcgctgcagtccctgccggaggacttccggctcgccgtctacctcgccgatgtcgagggtttctcgtacaaggagatcgccgacatcatgggcacgcccatcggcaccgtcatgtcccgcctgcaccgcggccggcgcaacctgcgccagctgctcgtcggatacgccgccgaccggggcatcacccgggccgcgtccgagccgcaggaggcgtgacccgatgccgagcgacgagaccgaacacgagaccgattgcagcatcgtgctcagcgaggtgtatctctacctcgacctggagtgcagcgaggaccgccgccgcctgatccagaaacacctggacgagtgctccggctgcctgcgcgagttcggcatcgagcacgaggtgaaggcgttggtcggccgctgctgcggcgacgagcgggcgccggccgagctgcgcgaccggctgcgcgtcaagctggtccagctggaggcccagaccgagacccgggagtaccttccgtaaccgttggactaagcggcccggcagcgtgtgcgctgccgggccctcaccgtctcgaaccgcaaccaccgcgcacttcgcccgtcgatgacgagagtgccgaaaaacgacaagcagagcgcagttgtttttcggtgctctcgtcatcgacgttgaggggcgaagtgcccgccgagcggagcgaggccatgttaactgttggggcgcttgccgtggttcgcgccgctcttcttacgggccttcttcttgcgagccttcttggccataagggcctccttcctcacgcttgctcagtcgccgatcgtagtcggcggggatgggccgccccggacctacccgtccgggatccgtgatttgatgaccttccctggaaacgtgacgaggaagggcgatccggaatggccgaagaagtccgtgccgagatggtggccaacgtgtggaaggtcgtggccggcgtcggtcaggccgtggccgagggcgacaccctggtgatcctggagtccatgaagatggagatcccggtggtggccgagtccgacggcacggtgggcgagctcgccgtgcacgagggggacgtggtccaggagggcgacctgatcgcggtgatcaactgattcatttcttcagccagcgcagcaggtaggatcggctgcgctggcgggggatgaccggcgtgcggacggtggccgcggccagctcgcgggccggccgggccagctccggggtggccagcgccagctcggcgaccgcccgggcgtgcggcccaccggccacctcggcgaatcggccggccaccacggcggccacgtcggcccgcgcctccggatccacccaggcgtaggtgaccagcgcgaacagcgccgcctgggtgacccggtcgacctcgccgtcgagcaggccgagcagcagccgacgccgggtggagtccagccacgcctcctcggaaccgtggtgcagcagcccgagacaggcccagacctcggcggcgcccgggtcggccgcgccggtcaccgcgggatggccgagcagcgcgagcagctcccacggctcgaccaggaccaggcccagcgcccggtcgtaggcggccggcgggtgcggccagccggtcgaggcgacccgcagcagccggtcccgcgcgtccggtgacggatcgccgttgactgtggggcggccgggagccagccgggacatcgaggccggcagcccgctcagccacggcacgtcccggcagcagtcgtccaggtcggtgtgctcgtgcgtgtcgtccgggtggtcgcggacgaagtcggcgagcgcgatcaggtgggccacctcgccgtcggcgcggaaccgcagccgctgcgcggtgtgcaccacgcagtcgaaccgcgggtcgcgttccagcgcgcggtcggtccagctcagtgcctcgtcgagccggcccaggtcggccagggtggccgccacgtcggcgtagacggacaggtcgtccgggtcgtacatgaccgcccggcgcagcgcggccagcgcctccgggatccggccggcactgcggaacgcgtagcccagccagatctcgccgagcttggacggccgggagcgggcgccgcgggtcgcccagtcgatcgcgagccgggcctcgcccagccgacgggccagcgccgagccggcgcccagcagcatcgcgtgctcgccgtgcgcggccacggtgtgccggaccacggtcaggtaggggcgcaggggctcggcggccgccgccggggccgggtcgccgaccgcggtgcacagccgcatcaccgtccgggccagtgcgtccgggtcgatccggccgccgagcaccgggtcgctgacccacggcaccccggcccagtcgacgtccggggtgtgcccgctggccgcggcgagcagggccagcccgtcctccgggcggccggccgcggcgagcaggtgtgcgtgcgcggccacccggccggccggggcgtgcggctccagcgggaacaggtccagcgcgccgtcggcccgggccgccaatcggctgagcagctcgtggatctccggcagggtgggtgcgtggggcagcgccccggccaggtggcgggcggcctggctcatctcgccggcgtccagggcggcgcgggcgagggtgaggtcgtgcgggaccggggggtgggcgtccacgagtgaagacagtacgggcagcgacgcgatctgtcagtcctcgcggctgcgcagtagtgcgcgaaagattgacgtactaagctttttcttgcaagactgcgcatctattgcgcgagaactgctcatctggggaggatgacatgacagagcgaggccacgggatggcagcggacatagcggagcagccggagggattcgcccgcctgctcgacgggccgcacgccgacgcgatcgccggagtcgccgcggagatcgcggcccgccgcccgcgcaacgtgctcttcgtcggccgtggcacctccgaccacgccgcgctttacggggcgtacctcaccgagatccggctcggtctcccggtggccagcgcgtcgccgagcgcgatcaccctctacggcgcccggcccgacttcaccggcaccctggtgatcggggtcagccagagcggcggctcgcccgacctgaccggcgtgctctccgccgcccgggagaccggcgcgctcaccctcgcggtcaccaacaacccggagtcgccgctggcccgggccgccgagctggccgtcgacgtggccgccggacacgagcgcgcggtcgccgccaccaagacctacaccgccgagctgctcgcgatgctgctgctggtcgagggcatccgggccggcgacgggcggctgcccgccgaggagcgggccgcgctggccgggctgcccgcgctggccgccggggtgctcgccgaccacaccgccgaggacgtggcccagcgctaccggttcgcgccgcacatggtcaccaccgggcgcggctacgcctacccgaccgcgcgcgaggcggcgctcaaactgatggagacgtcgtacgtgccgacgctggccttctccggcgccgacctgctgcacggcccgctcgcgatgaccgacaccgacgtgccggtgctggccgtggtcggcggcggccccggcgggaggtcgatggccgacgtgctggcccggctcgaggagcgcaaggccgacgtgctcaccgtcggcccggccggcaggctggccgtcccgcccgtcgacgagcggtacagcccgctgctggacatcctgccgctgcagaagctggcgctcgcactggcgctggccaagggcgaggacccggacgccccccgcggtctgaagaaggtgaccagcacgctttagacgaaacatcggcgtggcaggcttggcgtgtgtccaccctgcgcgatctcgtcgaggaacactccagcctgggttccgccgacatcgaccacctgcaccgcctggccggcgactggcagctgctctccgacctgtccttcgccgacctgctcctctgggtgccggtcaagggcgacaagccgcgggagttcgtctgcgtggcccaggtgcgcccgaccacggcgcccacggcgtatcaggacgaccaggtgggccggcgattcggcggccccgaggtggcccacctggaggtcgcgttcacccaggagcggatctggcgggagggcgacccggtctggtacggcgacaccccggcccgccacgaggccatcccggtgcgccgccgcgacgagaacgaccacgaggagggctacagcgaggtgatcgcggtgatcggccgcgacaccaacctgagcaccgcccgcacccccagccagctggagctcaactatctgaccaccgccgacgacctggcccagatggtcgccgacggtaccttcccgccggcccggcagcccggcgagatgaccacctcggcgccccgggtcggcgacggcctgatccggctggacgcctccggcaaggtcacctacgccagcccgaacgcccagtcggcgtaccggcggctcggcttcaacgcccacctggtcggcgaggagctggccgggctctccagccggctggccgccgacccgctggagggcaacgacgtcgccgagcggatccgctcctcgctgcgcggcgagttcccgccgcggatggagttcgaggcgcgcggcgccaccgtgctcacccgttcgctgccgctgctcccggccggcgtcccgatcggcgcgctggtcctggtccgcgacgtcaccgaggtgcgccgccgggaccgggcgctgatgaccaaggacgccaccatccgggagatccaccaccgggtgaagaacaatctgcagaccgtggccgcgctgctgcggctgcaggcccgccgggtggacgcgccggaggcccggatggccctggaggagtcggtccgccgggtcgcgtcgatcgcgctggtccacgagacgctgtcgatgtccagcgacgaggcggtcgagttcgacgggatcgtggaccgggtggcgaccgccgccaccgaggtctcggccaccagctttccggtgcacatgcgccgcgagggcaccttcgggattttgcccgccgagatcgccacctcgctcgtgatggtgctcaacgagctgctgatcaacgcggtcgagcacggcttcccggccggtgaggacgacgagcccgcccccgcgccggagcagccggccgaggtggtcgtcgccgcgcaccggttccgcaagcagctgcacgtcaccgtggccgacaacggtcagggcctgcccgagggcttccggccggacgccggccggttggggctgcagatcgtccgcgcgctggccaccggcgagctgcgcggcagcatcgagctgcgcaaccgggccggtggcggcaccgaggccgtgctggtggtcccgctcggcaagcgctgatccccggtcgccggttgtgcgatcctcggttttcggtgaccacccgcgggcagtgaagggccgcggtgatcgctctggacgcgtcagcggccagatcaccgtggcccggcccgcgcgggagcatgcggtcggcaccccggcggatgtgcgcacctccagaacttgatctttttgttgatcttcgaggttggtgtctgtcgatgatcgacgtcgtccggcctgcggcgtaacgaattagtaacagcaataggaataccccgggaagtgccgtggagcacactcccggattctggacctcactggcccacattcggtttgcgtgagaggcttaccggcatgaccgctgctatcgaccgccgcttcgtggctcgccgccacgtcgactacgggcgtgtcttcagcgcgatgtgtccggcttcctgacgccgcccccctttatttcgggcgcggacgacaagccggccctctcccgacgctgatgtcgcggagcctccaccaggccgcgattgtcctccggtgcccacgaaacccggaggaccgccgccatggcgcccagcaacactcccgctacaccggccgcccgcccccgtaaggcgcgcggcgagggtcagtgggcgctcggacaccgcgagccgctcaatcccaacgagcgcagcaagaaggacgacaacccgctgaacgtgcgggcccggatcgagaacatctacgcccaccggggtttcgcctcgatcgacccggccgacctgcggggccggttccgctggtggggcctgtacacccagcgcaaggccgggatcgacggcggacgcaccgcggtgctggaacccgaagagctcgaagacgagtacttcatgctccgggtccgcatcgacggcggcgcgctcagcgtcgcccagctgcgcaccatcgccgacatctccaccgagttcgcccgcgacagcgccgacatcaccgaccggcagaacatccagctccactgggtgcgggtcgaggacgtgccggagatctggcgccggctcgaagcggtcggcctgcagaccaccgaggcctgcggcgactgtccgcgcgtggtgctgggcagcccggtcgccggcatctcggtcgacgaggtgatcgacggaacgcccgcgatcgacgagatcctgaagcggtacatcggcgacccggcgtactcgaacctgccccgcaagttcaagtcgcagatctcctggctggccgacgggccgtaccaggccaacgacgtctccttcgtcggggtcgagcaccccgaccacgggcccggcttcgacctctgggtcggcggcggcctgtccaccaacccgcggctggccgagcggctcggcgtctgggtgccgctggccgagatcccggacgtctgggagggcgtggtcgggatcttccgcgactacggctaccgccggctgcggcaccgcgcccggctgaagttcctgctcgccgactggggcgtggccaggttccgcgaggtcctggagaaggaatacctgggccgcgcgctgatcgacgggccggcgcccgacctgccggagaagccgatcgaccacatcggggtgcaccggcagcgcgacgggaagaactacgtcggcgccgccccggtcgtcggccggtcctccggcacccagctcggcaagctcgccgacctcgccgagcggcacgggtccgaccgggtgcggctcaccgcgtaccagaaactgctcgtcctcgacatcgccgacgagaaggtcgagaccgtggtcggcgagctgcgcgagatcggtctggaagcccgcccgtccacctggcggcgcggcaccatggcctgcaccggcatcgaatactgcaaactcgccatcgtcgagaccaaggcgcgcggcgaggaactcgtcgcccggctcgaggaacgcctccccggcttcgacgcggacatctccgtgcacctcaacggctgccccaacgcgtgcgcccgcacccaggtcgccgacatcggtctcaagggccagctggtcatgaacgcgcacggcgaacaggtcgagggcttccagatccacctgggcggcgcgctcggcatggccaagggggaaaccgccggcttcggccgcaaactgcgcggcctcaaggccaccgccgaggaattgccggcgtacgtcgagcgggtcgcccggaactaccgggacggccgcaccgacggcgagacgttcgccaactgggtgatgcgggccgaagaggagctcctcaaatgagcgacgcccgatccgccccgctgtactgcccctactgcggtgaagaggacctccgccccaacgagtcctcgcacggcgcgtgggagtgccactcctgcgcccgagtcttcacggtcaagttcaacgggttgctgtccaagggagctaccaaatgagcatcctcaacgccaccggcctgggcctgatcaacctgggcgcgccgagcgcccccgctgaccccgcccgccgcagcgccgacgacctgcgcgcgctcgccctgcaggccgcgcaggacctggagggccggaccgccgaggagatcgccaagtgggcgaccgacaccttcggcgcccggttctgcgtcaccagctcgatggccgacgcggtggtcgcgcacctcttctcccgggtcgcccccggcgtcgacgtggtcttcctggacaccggcctgcacttcccggaaaccctcaaggtccgggacacggtcgcccgcacgatgaacgtcaacgtccgctcgatccgcccgcggatgaccgtcggccagcaggacggcgaatacggcccccggctgttcagccgcagccccgacgagtgctgcttcatgcgcaaggtcgagccgttggaacgggccctgaccgagtacgacgcgtgggccaccggcctgcgtcgcgacgagtcgccgacccgggccaacacgccggtcgtcgccttcgacgccaagaagggcaaggtcaaggtcaacccgatcgcggcgtggacccaggccgacgtggaccgctacatcagccggtggaacgtgccggtcaacgaactgttcaagaagggctacggctcgatcggctgctggccgtgcacccgccgcaccaaggccggcgaggacccgcgggccgggcgctgggccatgttcgagaagaccgaatgcggtctgcacgtctgatcgccgcgcggcccgcggtggtcctggtcgcccacggcagccgggacccgcgggcggccgcatcgaccgaggcgctggcccgggcggttcgccgggcacggccggagtggctggtgcgggcggcgtacctggatcatgcggggccgcggccgctcgatgtgctgagcgggctcggggagcggcgggcggtgctggtgccgctgctgctcacggcggcgtatcacgggcgggtggatctgccggctgtgctggcggaggcggcggggcttccggtggaggtcgtgctggccgatgtcctcggaccgttgccggtcgcgccggtcgatgtcctgcggccgcagccggcgccggtcgcgccggccgatgtcccgcggccgccggcggtcgcgctggccgaagttctggggccgttgccggtcgggccggcggcgctgctcatgccggggctgcttctggaggctctgacgcggcgcctcgccggcgccctcggcgactttacggatatttcgtctttggtgccgaatgagcgcttcgatgccgtggttctctccgcggccggaacgcgcgacccggtggcgcgcggcacggtggagcacgccgccgccgccctgggagcccgcctgggggtcccggcgcgggtggcatatgcctcaggggtgggtccgcgggccggagaggccgttcgggggctccaggaggcgggagcccggcgggtggcggtcgcgggatacttccttgccccggggctcctctacgaccaggccgtcgagtcggcccgggaggcgggcgcggtggccgtcgccgagccgctgggcgacgcgccggaactggtgggcctcatcagcgcccgcgtagcggccaccggcgtccgtgtcctcgccgctgcctgatacccggttgcgctcggctgcctgagccgccgcatcggtccgtgccgtgcctcgtcgcgcggcgttgtgcttgcttgcgtggcgtcgcgtgtcatctgcgcggcgctgtgcttcgtcgcgcggcgttgtgccctaccgccgcgccgcgccgtgcttcatcgccgcgctgtgcccaaccgccgcgccgtgcccaaccccgcgccgtgcttcatcgccgcgttgtgccgtgccgtgccgtgccgcattggaccgtgccgaccccgcccgcgagtccgttgaggagccgggaagtccggggcgggatgtccgggggcagaggccggccgcagggtcagagtggacgatccaaatgatcgacgactacctaaagtgacgatcactctgcgctacgcgattttcggcgcttccggcgcggcgccgcgccccggtcgagatcggagcgtccacagcggagtgtgcccgagtcgcgacggaaaccgatcagcgggccatttcgagatcatttcaggagtacgggcaaacgtacggtgatcgaattggcgcgcaggggaatggcggcggtgggtaagcggcccgaaacagcaagacgccccggtgccggtacggcccggggcgcaaatgctgtgtgggggattgaatcaagcggtgggagcggacacgcgaaggccgccgcgacgcttgaccgcgcgccgctcgtcttcgctcatcccgccccatacgccggcgtcctggccggactcgagtgcccacgagaggcattcctcggtcacggggcaccgccggcacacggccttggcctgctcgacctgcaggagcgcggggccggacgtcccgatcgggaagaacagctccgggtcctcgtcgcggcagatcgcatcgtgacgccagtccatggcggcaaactccttgtttcggatggggtaatgaaaacagtgctgtttacctatatgcatgcgctcgcggtgccgacgggttgtacccgtacgctcaccagagcgttagcaagcttttgagtttggcggccgttctgcgcttccagatttagaacgcgcacatgtggcaaccggttacttcttatcgcttgtgaatgctttcacgaactctcgcgatgtcaagggtagcgctggaagtttcttccgacgggtgagctggctcacgtacccatatgtccggttctcctgctcttgccggagccggttgacgaacgctcccatcaatgtagtacggtcccggccttcttgccgaccttttgcccgtgtttctgtaacggatcgtgagcacgtcccgaaagacgtacccctgcgtcagcagatcacacgtagcgctgaggggacggacacgaagtgcaccttctgccgctcgccgagatagtcaccgtccagctggaatgcctgggggcgggacgagatcacggtgaactccggaagatcatgcagccgtaacacttgtttaccgtgcggatcaccggatcgccacgcgagttgtgtcacggtcctcgtggttgcggaaaccttgagtttgcgcagggccagcacatcgagcccgagatcgaaggaagcgtccggattggggtccaccggacggttgccggcgtacgtccagggggcggtgttctgcacgatcaccgtgcccagaccggtgtcggcctcctcacccggacgttcgagggtcatcggcggatcggaccggtccgtctcggtgagtaattggccgaccatcgcccgtagatagaggcccggcgtcgaggtccggcctcgcagccgggcctgctccacccggcggaccaccgcggcgtccaggcccaggccggcggcgaaggtgaagtagcggtcgtcggcgcgtccgagattgatcacccggtgccgcccgtcgcggaggccgtccagaatcacgctggtgccgtccgcccagtcgcgggggagtccgagcgcgcgggcgaagacgttggtggagccgccggggaccacggcgagtgcgggcagccggtatgccgccgggccgggcaggccggccagtgcgccgggcgcggtgagcaggccgttgaccgcctcgttcacggtgccgtccccgccgagcgtgaccaccacgtcgacaccggcctcggccgcggtgcgcgccagcacggtggcgtgcccgcgccgctcggtgtatcgcacggtcaggtcggtcgcgctgcgcagcgcgcggacgagcacgtcgcgtccgcgctcggtggtcgtcgtcgcgcgggggttgaccaccagcaaggcacgcatggcggcaccttaccggccggagcccgatccggcggtcggtatggtgcagccgtgaacgctgagaagcccgtgacgaccgcggcggcgtccctcgaatggggagtccggctgctctacctgcaatgcgcggggctggccgggctcacggcgtacctgattgtcctcgatctgacccggaccggagcggacgtgggcgtggcggccgccctgacggtgctggcggccctggccgccgtggcggtcttcctcgtcgcgcgggcgctgggccgccgccgggtccgagcccgcgggccggccgtggtcgtgcagctgttcctgctggccaccggcggtttcctggtccaggtcggaccactctggctgggtgtcgtgctgctcgtcgtcgcggcggtcaccgcggtgctggtgctgttgccggcaagcagccgagcgttgggtgtcgattaaccggtcccctgcggccgatcaaggcataacctggttgggtgaccggctcaacggtgcgcccgcccgcctatcagcaactcgcggacgatctgcgtgcggatatcacttcgggacgactgcagccgggcgagcggttaccgcccgagcccgagctgtgcgtcaagatcggcgtcagccgcagcacggtgcgcgaggcgttacgcctgctcgccagccagcatctgatcgtcaccacccgcggcgtgaccggcgggagcttcgtcgcgcatccggatgccgggcagctcgccgagggcctgtccaccgggttcgcgctgctcgcgcactcggccggggtggggctcgccgacctgctggagctgcgccgggcgctggaggtgccggccgccgggctggccgccatgcgacggaccgacgcgcacctcgccgagatgcgggcggcactgttcgacccggcgctcgacgatctggacaccatgctcgcggcgcactcggtgtttcaccgggcgctcgccaaggcgaccggcaacccgctgttcgagctggtgggccgcccgctgtaccaggcgtcgtacggcgaggaggtggtgtccgacctgccggagcaatactggccgcggatcgacgcggaccaccgggagctgcttgaccacctggtcgcgcgggatgccgaggcggcccggcagaccgcgtcacggcacctcgactacatcgcgctcaccgcgacggtgccgcgcccctgaggggatcagtattcggtgcgccgggtgagcaaccggatcgtcgcgtgctggccgttcgcctcggcggcggccgacgtggtcagcgcggtcagcaccttccacgcgaaggacgactcggacggcagccgcgcaccgcgcaccgtggcgacggtgacctccacggtcagcgcgtcgtcggtgacggcgaaccggcactccagctcggcgccacgggtggcgatcgcgagcagcatggcgcacgcctcgtcgacggcgatccgcagatcctcgatctcgtcgagggcgaagtggagccgggcggccaggccggcggtagccgtccggagcacgccgagataaccgccgtcggcgggcaccgtcaggagcacgacgtcgtctccgacttccggctccgcctgggtcagctgggacacgcgcgacctcctcctgtcggtggagactctaaccggttaccacctgtcatcgcagcggccggcgcaccccgcggggcacgccggccgagtcgcactcaggcctgcttggtctcccagaaaatcttggagatctcctcgatcttgccgagcagctggtcggcgaccgcgacgtcgaccgagcccttggcgccggacgcgccggcgagcttggtggcctcgttgaagagctggtgcaggttcgggtacttctcgaagtgcggggccttgaagtagtcggtccacagcacccagaggtggtgcttgaccagctcggcgcgctgctccttgatcaggatggcccgggtgcggaactcggggtccgtgttcgccgcgtacttctcggcgatggccttgatcgactcggcctcgatccgggcctgggccgggtcgtagacgccgcagggcaggtcgcagtgcgcgctgaccacggtgcgcggcatcaggaaacgcggaagtcgcatcaggactcctccatagagtttgcgatgatccgggactgacactaccccttacatccccgggctaacgcgacggaggcttgctgccttgaagtggcaattaccactattcgccgtgctggtgcacggcccgtcgatggcgccggcactgcgtcacggcgacgccctgctcgtccgtcgcggcgcgcgggtaaggaccggcgacatcgtggtcgcccgcttccgttcccggccgggcctgctcgtcgttaagcgggcagtgcgggagcaggccggtgggtggtggatcgagggggacaacgctctggtccaggacgactcacgggcgtacggggtggcagatctcattggccgagtggtgtttcgctactacccccgtccagggcggttacgttagtctccagtatccccagcgcacacccgcgctgcggtcgctttcccgggtgacccccgcatgcaccgccgtctggcgcatactcgcgaccagcacgtgtcaggtgcgacgtatcaatgtcgatgccgtgtggagttcaccgtgtctttcttcagtttcgagctcgatcccgccctggccgctgatccggtcttcgacctgcaccgccggggcaagatgacgatgagcgcgaccgttccgctggccagccgggacgatctgtccctggcctacaccccgggcgtcgcccgggtctgcgaggccatcgccgccgacgaatcgctctaccccgactacacctggacgtcgaacaccgtcgccgtcgtcaccgacggatccgcggtgctcgggctcggcaacatcgggccgaaagccgccatgcccgtcatggagggcaagtcggtgctgttcaagcagttcggcggggtcgactcgatcccgatctgcctggacacccaggacgtcgagggcatcatcgcggcggtcaaggcgatggcaccgtcgttcggcgggatcaacctggaggacatcagcgccccgcgctgcttcgagatcgaacgccggctcgacgccgagctggacatcccggtcttccacgacgaccagcacggcaccgcggtcgtcaccctcgccgccctgcgcaacgccgccgccctcctcggccgctccttcgccgacctgcgcgtcgtgatcagcggcgccggcgcggccggggtcgcgatcaccaacaccctgatcgcggccggcgtccagggcgccaacgtgatcgtcgtcgactcgcgcggcatcatccacgccgaccgcaccgacctcaccgcgaccaaggccgacctggccgccgccaccaacgtctcgggccgcaccggcggcatcgccgaggccctgatcggtgcggacgtcctggtcggcgtctccggcgggagcatcccggaggaggccctctcgggcatggcccccggcgcgatcatcttcgcgctggccaaccccacccccgaggtgccgccggcgaccgcccacaagtacgccgcgatcgtcgccaccggccgcagcgacttccccaaccagatcaacaacgtcctcgcgttcccgggcatcttccgcggcgccctcgacgtccgcgccaccaccatcaccgacgcgatgaaggtggccgcggcagacgccatcgccgcgatcgtcgccgacgacctccgtccggaagcgatcgttccgtcaccgctcgacccgcgggtcgcaccggcggtcgccgccgcggtcgccgccgccgccgtccgtgacggcgtggcgcgccgcaccccggcgctcgcgccggttcaggcctgtcagaccgtctgagccggttgccgggtcgctgcttcacctgacgcgccgcgccgccttccggcggggcggcgcgccgctttccccggggatcgccggacctcgggccgattcccgactggcggtccgctgtccgatttcaaccccgatggtgtacgccgtgaagcccgccccggtcgcccattcccgcgagtggcaccgttcccggcagcgctcttcggccggtgtggcggctcccggcgggaggtggcggtgtggcgtcgccgccggccggccgttgaggggccggggtggccggtgggtgattcggagccgatcgatgtggggtgtgggcccggcacgacggctagggtcggatcatgcgcgctgcctacgtgtcccagcttcagcccgacgagccgttgagcggcctgaccgtcggcgatctgcccttcacaccgccggcgggctgggtgccggtcgaggtccgggccagttcgctcaaccagcatgacgtctggtcgctgcgcggggtgggcctgcccgccgaccgcctgccgatgatcctcggctgtgacgccgccggggtgaccccggacggcgccgcggtgctggtctatccggtggtcgaggacaaggctgacccgcggggctattcgctcttctccgagcggcaccccggcacgctggccgagcgggtcgccgcgccccgggagaacctgctgcccatcccggagggtgtctccttcgccgaggcggcttgcctgcccacggcatggctgacggcgtaccacatgctcgtcacccgcggccgcgccgaccgggccggcgcgatcctggtccagggcgccggcggcggcgtcgccacggccgccgtcgcactcggcgtcgccctgggcaagcgggtctacgccaccagtcgacaccaggcgaaacgtgaccgcatcgccgagctgggcgcggtggcggtcgagcccggcgcccgccttcccgaacgggtcgacgtggtcatcgagtccgtcggcgaacccaccttcgaccactcgatgaagtgcgccgcccccggcgcccgcatcgtcgtctgcggcgccaccgccggccacctggcccgcatcgacctgcggcgggtcttcgccatgcagctggaaatcctcggcagcagcatgggcacccccgccgaactcgccgaactcctccagatgtgcgccaccggccgcatccacccggtgatcgactccacccacccgttcgacgccaccccggacgccttcgcccgcctgctgtcccccgacctcttcggcaaggtggtcatcacccactgaggtcaggcccatgaccgttcattgaccgcagggtggtgaccgttcattgaccgcagggtgctagctagctagcggccgccgacctgtgccggtcggtgcagcggctcagaccggcagggccagggcccgccgggactcgtcggcgatctccagttcctcctcggtcgggatgacgcacaccgtcaccggggcgccgtccggggagatgatcagatcgttgcggctgttgcgggcttcgtcgacgatgatgccgaggggctccagcccggccagggcggcggccctgacccgggaagagttctcccccacgccggccgtgaaggtgatcgcgtgggcaccgccgagcacggcgagataggcgccgacgtattcgcggaggcggcgggtgtaggtcaggaacgccagctcggcttccgggtcgccggcggtgacccggtcgaggacctcgcgcatgtcgttggcgccggtcaggccgagcaggccgccgtgccgggtgagcgagtcctcgatctcgtccagcgacaggccgccggcgcggtgcaggtggaagatcaggctggggtcgatgtcgccggagcgggtgcccatcaccaggccgctgagcggggtcatccccatcgacgtggcgacgcagaccccgccgtcgacggcggcggcgctggcgccgttgcccaggtgcagggtgatcacccgggtgtcctcgaccggccggtcgaggacgtgggcggtccggcgggacacgtaggcgtgcgacgtgccgtggaacccgtaccgccgcaggccgaagcgttcggcgagggtgcggtcgacggcccagatcaccccctccggcgggatcgtcgagtggaacgcggtgtcgaagacggcgacctgcggcacctcgggcagcagctcgcgggcgacccggataccggtcagcgcgcccgggttgtgcagcggggcgagcggaacgagttcctcgaccgcggccaccacctcgtcggtgatcaccgtggcctcggtgaagcgttcgccgccgtgcaccacccggtgcccgaccgcggccaggtcgctcaggtcgagccggtccatcaggtcgcgcagcgccgacaggtggtcggtggcgtcgccgcccggctcgccgatccgctggatcagccccttggcctggacgtcggcgccgtcgaagaggcggtaccggaccgacgaggagccgcagttgagcacgagtacccgggtcatctggctcccgcctggatcgccgtgatcgccacggtgttgatgatgtccttgacggtggcgccgcgggacaggtcgttgaccgggcggcgcaggccctgcatgaccgggccgaccgcgaccgcgttcgccgagcgctggaccgccttgtaggtgttgttgccggtgttcaggtcggggaagacgaacaccgtggcctgcccggcgaccgcgctgccggggagtttcgcggcggcgaccgcggggtcgatggccgcgtcgtactggatcgggccctcgaccggcaggtccggccggcgctcccggaccagggcggtggccgccgcgaccttctccacgtcggcgccggcgccggaactgccggtggagtaggagagcatcgcgacccggggctcgatgccgaaggctgccgcggtcgtcgccgaggagagggcgatgtcggcgagctgggcggcgtctgggtcggggttgaccgcgcagtcgccgtagaccagcacccggtcggccagcagcatgaagaagacactggacgcgacggacacctcgggcaccgtcttgatgatctcgaacgccgggcggatggtggccgccgtggtgtgcaccgagccggacaccatgccgtcggcatagcccgcggcgaccatcatggtgccgaagtagttgacgtcgcggaccacgtcgtatgccaggtcgagggtgaccgcgcggcccttgcggatctcggcgtagcgggccgcgaagtcgtcgcgccacgagctggtggccgggtcgatcaggtgggcgtcgccgatctcgacgccgatctcgcgggcccggcgggtgatctcggccggatcgccgagcagggtcagctcggccaccccgcggcgcagcagggtttccgcggcgcgcaggatccgctcctcggcgccctccggcaggaccaggtggcggcggtcggcgcgggcccggtcgatcagatcgttctcgaacatcagcggggtgacccgggcggagcgggccacgtcgagcaccttggagagctcggcggtgtccacgtgcgtctcgaaggcgccgagcgcggcctgcaccttgcggggtgtgctgagccgggcccgcacccggtcggacagggcgatggtgtggaagctgtcggccttggtgaccagcatcgcaaggccggtgccgagccgctcgatgacccgcacgacgcgcgggtcgggtggctcgccgagggtgagcaccagcccggccagggtgaccgtgccggccgcgtgcgccgcgctcgccgcgaccagcaggtcggcgcggtcgccgggagtgatcagcagtgccccgtcggtgaggtgctccagcacggtgggcacgtgggcggcgccgacgacatagtcgagcacgtcccggtcgagggcgccgggcgtgccggacaggacggtcgcgtcgagcgcgtcggcgacctcgccgacggtgggcgccgcgatcgccgggacctcggggatcgtccagaacgggacgggcaggctcggcgccgggccgccgccggcggcggccggcacccggttggcgatcaccgcggccaccgtggcgcccaggtcggtgaccgagtggtacgcactgcgggccgccgccgcgagggactccccgccgcgcccggccccgctcaccaccggcaccaccacgctgccgaactcggtcgccagccgggcgttgaaggccagctcccgaggcagttcgtcgtggccctcgtcgccctggtcggcgaagtcgctcccgatgatcacgaccgaggtgctctgccgctcgaccgcgcgataccgctcgacgatccggccgatgagctcctcgcgccggccgtcggcgatcaacgcggccgcctcggccagggtgaccccgaacgactcggcggccggcaccggcgagggataacgctcccgcagggcggccagcagcggatcacggtcgacagccgggaccaggggccggaacaccgccaccccggcgacctgacgggacagcagctcgacgatccccagggccaccgtgcccttgccgacagccgggcccaggcccgctacatagacactccgcgccacgcccccaaattaccggctgagcatgaacgccgccgggtcaaagggcccgcctgtggacaaccctcagtcctcgtcgtcgtcatcccgggcgagccaggtggcgaaccgctcgatcggggtctcgaactccgggttcaggtcgacgaaggtgcgcagctgctcgccgagccactcgagcgtcacggtctcctcgccgcgccgctggaccagctcctcgatgccccgatcggtgaagtacatggtccgaatagtagaagggggcgccccgccgcagcggaacgccccctgctcagacgagggtcacgggcggggcagcgacgcctcgatcagcgcctgctgctcggcctcgtgcatcttggccgagccgaccgccggggcggccgccgccgggcgggagatccgccgcagccggacgccctccaggtgctccagcaggttgagcgcgacgaacgaccaggcaccctggttggccggctcctcctggacccaggcgaagtcctcggcgttcgggtactgcgccaggaccgccttgagctcgtccaccggcagcgggtagatctgctccatccggatgatcgcggtgtcggtgatgccgcggtcggcccgggcctggaacaggtcgtagtagaccttgccggagcagaacagcacccgcttcaccgagccggcgtccagcggctggccgttgaccccggcgtcgccgagcaccggctggaacgtgccctgggtgaagtcggccaccgaggacaccgcgagcttgtgccgcagcagcgacttcggcgacatgacgaccagcggcttgcgcttgctggacagggcctggcggcgcagcaggtggaagtagttcgccggggtggtcgggttcgccacccgcatgttgtcctgtgcgcagagctgcaggaaccgctccgggcggccggacgagtggtcgggcccctggccctccatgccgtgcgggagcagcagcaccagcgacgactgctggccccacttcacctcgccggaggagaggaactcgtcgacgatcgactgggcgccgttgacgaagtcaccgaactgggcctcccacaggaccagcgcgtccgggttctccaccgagtagccgtactcgaagcccatcgcggcgtactcggagagcagcgagtcgtgcacgaagaaccgcgcggtgccggtggccagcgaggcgatcggcaggaagtccttgccggttcgcgagtcgacgatcgaggcgtgccgcgaggtgaacgtgccgcgacgggagtcctgaccggcgagccggacggtgacgccctgggcgagcagcgaaccgaacgcgatcagctcgccgaagccccagtcgatgccgccgtcggtggacatcttggcccgccggtcgagcagctgctggacccgcttgtgcggggtgaagccctcgggcagctcgatgtgcgcctggccgacggcccgcacggtgtccgcctcgaccgcggtggccacctgcggctccggttcctcggcgatgatgtgcggccgcggcgggctgccggccgcgtcccgggtggccttgaagacctcctccagccgggactggtagtcgcgcagctgctcctcggcgtcctgcacggtgatgtcgccgcggccgatgagctcctcggtgtacagcttgcggacgctgcgcttggtgtcgatgatctggtacatccgcgggttggtcatcgacgggtcgtcgccctcgttgtgaccgcggcggcggtagcagatcatgtcgatcacgacgtccttgttgaacgtctggcggtactcgaaggccagcttggcgacccgcaccacggcctccgggtcgtccccgttgacgtggaagatcggcgcctcgaccatccgggcgacgtcggtcgagtacatcgacgagcggctgtactccggggcggtggtgaagccgacctggttgttcacgaccacgtggacggtgccaccggtgcggtagccccgcagctgggagaggttcagcgtctcggcgaccacgccctgaccggcgaacgcggcgtcgccgtgcaccagcaccggcagcaccgtgtagccgtgcaggcccaggtcgaggcggtcctgcttggcccggacgatgccctccaggaccgggtcgacggcctccaggtgggacgggttcgcgaccacgctgacggtggtggagtgccggccgtcgggcgtggtgtatttgccggtctggcccaggtggtacttcacgtcaccggagccgtgcgccgacttggggtccatccacccctcgaactcgttgaagagcttctcgtacggcttgccgacgatgttggtgagcacgttcagccggccgcggtgggccatgccgatcaccatctcgtcgagcccggcctcggcggacgactggagcaccgcgtcgagcagcgggatcagcgactcgccgccctccagcgagaaccgcttctgcccgacgtacttggtctgcaggaaggtctcgaacgcctcggcccggttgagtcgcagcaggatctgcttctgctcgtcggtgtccggcttggcgtacttgacctcgatgcgctcctgaacccagcggcgctcctccgggtcctggatgtgcatgtactcgatgccgatccggcggcagtagctgtcgcgcagcacgccgagcacgtcgcgcagcttcatcttctgcttgccggcgaaaccgccgaccgggaacgtgcggtccaggtcccacagcgtgaggccgtgctgcagcacgtcgaggtcggggtgcttgcggatggtgaactcgagcgggtcggtgtcggccatcaggtgaccgcgcacccggtacgcgtggatcagctcgatcacccgggcggccttgtcgatctggccctcggaggtgtgcgcgacgtcgcgcacccagcggaccggctcgtacgggatccgcagcgaggtgaagatctcgtcgtagaagtcccggccgccgagcagcagctcgtgcatcaccttgaggaactcgccggactgcgcgccctggatgacccggtggtcgtaggtgctggtcagcgtcgtcaccttggagacgccatggtcggtgagggtctcgtcgctcatcccggcgtagggcgcggggtactccagcgcgccgacgccgatgatcgcggactgaccgttcatcagacgcgggatcgagtgcaccgtgccgatgccgcccgggttggtcagcgagatcgtggtgccggcgtagtcgtccatggtcagctcgttgcgccgggcgcggcggaccacgtcctcgtacgcctgccagaactgccggaagtccatctgttcgcagttcttgatggacggcaccaccagggtgcgcgacccgtccttcttggccaggtcgatggcgatgccgaggttgatgtgctccggctggaccagcgtgggcttgccgtcgacctcggcgtagatgttgttcatctccgggtgcgcgacgaccgcccggaccagcgcccacccgatcaggtgcgtgaaactgaccttgccgccccggccccgggagaggtgattgttgatcacgatgcggttgtcgatcatcagtttcgccggcaccgcgcgcaccgaggtggcggtggggacctggagcgaggcctccatgttctgcacgatcttgccggcgacgccgcgcaggaccgtggtcttcgccccggccggggcgggctgggccgccgccgcgggcttcggtgcggccttgaccggctccgccttcttcgccgccggggcgggcggggtgaccggcttggccggcgccacggtggccgcggcgggcgcgtcggtgccggccttggcggcgctcttggtcgcgttcgccgcggtggcctcgtcgggtgtcacgatcgagcccgaggcggtcgccggcttgtagtcggcgaagaaatcgtgccaggcagggtcgacactggtcggatcggccaggtatcgctgatacatctcgtcgacgatccactcgttgggaccgaaatccgcgagtgggttgtcctgcgaagtctgctgcgtcgacactgccgcgttcgcctctttcaccgtgtttgtcatcacgtgaccaactcgtcacgcgggacgggctaggatccggtaccaggctacgccgtgcgcgagcgcggtccgtccggacgtccgctctgtgagcccggacatcgatcgcgtgcgtcacaccgtggcgatccaggtggcccgggccaccgccagccgccgcccgtccgggccgtgcaccgccgagtccaccagggccttgcgaccggccagctcggacaccgcgccggtgatcacacaccgtgcgcccggctcgggcagcgcgacagcggccaccgccaaccggcccagcacgtacgggcggccctcgcggatcgccgcccagccgcccgggcagtccagcgccgcccacagcagcggcaggtcgacctcggccggcaccgtccacggcgcggcggtccggccgtccggcagacgccccgggaagatccgcaggccgtccccctcggcacggtccgggccgcacacgaaacaggtggggaaggggtgaccggtgaagccgggatagtcgcgcgaggcggcgaccgcggtgtcccagccgaccggctcgacgcccggcccggcgttcacggcgccggcgtcgagcgaggcgatcagctcgccgtcggcgtacacaccgtcgtctcggaccgtgagatcgacctccaggggcggaggccgccgcagggtcacctgatgggtggcgccgtccggcgccgcgccggcggcgacggcgaaggcgccggcgcaccagccgccgttgccggagccgggcggaccgttgaaacgtgcgggaattcgcatcctgcgaccttcgcacaagccgttcatcagccggacacgcatcgccacctgacccgacactccatcggcagctgtcacccttacacaggtcacatggcagttctgatgacagccgccgcacccaccgggaccagcggctacacgcttctcatcgcggatcgggcggcgcagatcgaggccgcacagcgactgcgtcacgacgtcttcgccggcgagctcggagccaccctcacgaccgcggccgacggacgcgacgtggacgcgctcgacgagttctgcgaccacctgatcgtgcgcgacgacgcgaccggcgcggtggtcggcacctaccggatgctcccgccgcgcgccgccgggcgggccggccgccgctacgccgacggcgagttcgacctgagcgcgctgcgcccgctgcgcgaccagctggtcgagatcggccgctcgtgcgtgcatccggaccaccgcaccggcgcggtgatgaacctcatgtggaccggcatcgcccggtatctgcacctgaacgacctgcgctggctgggcggctgcgcctcggtaccgctggccgacggcggcgggctggcggccggggtgcgggagcggatcaacgccgggcacctggccccgccggcgctgcggatccgcccgcgcaccccgtggacgcccccggccgatctggtcgccgacccgaaggtgacggttccgccgctgctcaagggttacctgcggctgggcagctgggtctgcggcgaaccggcctacgacccggacttcgactgcgccgacttctacgtgctgttctcgctggaccggctggacccgcggtaccgccgccacttcctgggcggcgaccgatgagcacgctctggcagccggcctcgggctgcggggacgcctgccgcaccggcggcgggccgcgggcgcgcggctggaccgccggattccggctcaccgggatgctcctggtgctgctgctcggcctgctgccggccgcgctgatccgcggcgcggcgctgcgcacgctggcccggacgatgctcgcggtgatgggcgtgcggctgatccggcgcggcccggcaccgcgcccgggcagcctgctggtggccaaccacatctcctggatggacatcctggcgctggtcgcggtcacgccggtgcgcctggtcgccaagcacgacgtgcgggcctggcccgggatcggtgcgacggcgggccgcagcggcaccatcttcatcgaccggacccggccgcgggagctgcccgtgacggtgggcgaggtggcccgggcgctgcggggcggccgctcggtggcggcgttcccggagggcaccacgtactgcggggccgagcagggggacttccgtccggcgctgttccaggcggcgatcgacgccggcgccccggtggtgcccacctcgatcatctacgacaccgccgaggcgtcgttcatcggcgacgacacgctgctggagtcgctgctgcgggtggcccgggtgcgccggaccacggtcaccgtgatcaccgcgccggcgctgcggccgatgccgggggccgaccgacgggcgctggcgcgggccgcgcagcgcagcatggccgggcacgggtaccggctggccgcctgattccctctcacagataattttcagcaagcctgcagcggaggtgcagcgggcggggagaggatggccgtatggccgcccagacccagcgcaacgacacccagcctaagcagagcgaggcgaagttgctcgtcgtcgaggacgacgccaacatcctcgagctgctctccgccagcctgcgcttcgccgggttcgatgtgaccaccgcgaccagtggcagcgccgcggtcagcgcggcccgcagcgcggcgcccgacctggtcgtgctcgacgtgatgctccccgacctcgacggcttcgaggtgatccggctgatgcgcgagggcggacagcgcaccccggtggtcttcctgaccgcccgggacgggaccgacgacaagatccgcgggctcaccctgggcggcgacgactacgtcaccaagccgttcagcctggaggagctgaccgcccggatccgggcggtgctgcgccgcaccacggccggcgaggagcagccgtcccggctggtcttcgccgatctggagctcgacgaggagacccatgaggtctatcgggcgggcagccgggtgcagctctcgccgaccgagttcaagctcctgcgctacctgatgctcaacgccaaccgggtgctctccaaggcgcagatcctggaccacgtgtggaaatacgacttccgcggtgacgacaacatcgtcgagtcgtacatctcctacctgcggcgcaaggtggacaacgtgcaaccgcgcctgatccataccctgcgcggggtgggttacgtgctccgtaaacccgccgtctaggccgcgatgatgtcgatctccgagcgggtgcgccaggcgttcccgccgcagcccaccctgcgcaagatctcgctgcggaccaaactcgtcgcgtcggtgctggtcctggtgttcgccgcgcttacgctgatcagctcggccagcaccatcgcgctgcgcacctatctgatgtcccggctggacgcgcagctcaccgagttctccgaggacgcggccgtcctcattcaggacgactcgggcatccgggtctacacgccgcgggattacctggtcgtgctcacgagcgtcggcggggtcggcgtcggcgtcggcagcaagagcagattgacgagcggcaacagcctgcccacgctgatcaccggggcggagaaggtcgccgagtacgacggcaagctgtacacgagccggtcggccgacgggttgtacacctggcgggtccgggtcaaggtgctggacaacggcgacgtgctcacggtcggcgagcagatgggcaacgtccagggggtgatcggccggctggtgtgggtcgacgtgctggtcggcacgggcgtgctgctcgccctcgcgatcgtcggcgcggcactggtccggcagagcctgatcccgctgctgcagatcgagcggaccgccggccggatcgcggccggcgactacagccagcgggtgcccgacccggaggtggacggcggtgagccgaccaccgagctcggccggctgtccaccgcggtgaacgcgatgctggcccagatcgaggcggccttctacgcccgggccacctcggagcggcaggccatggaggcggccgaggccgcccagctctccgaggggcgcgcggtgcgctccgaggagaagatgcggcagttcgtcgcggacgcctcccacgaactgcgtacgccgttgaccactatccgtggcttcgccgagctctaccgacagggcgcggtctccgacccggaggcggtcgcccgcctggtccgccggatcgaggacgaggccgcccggatgggcctgctcgtcgaggatctgctgctgctcgcccgcctcgaccgggagcgcccgctcaatctggccccggtcgagttgccggtgctggccgtggacgcggtcggcgcggcccgggccacccacccggaccggaccatcgagctggacgtccgggacgaccacgagcggctgatcgcgctcggcgacgacgcccggctgcgccaggtgatcgggaacctggtcaccaacgcgctggtgcacaccccgccggaggccaccgtggcgctgcgcctctacgccgccgggccggaccgcgcggtggtggaggtggccgacaccggcccgggcctgagcgaggagcagcggagccgcgtcttcgagcggttctaccgggcggacggcgcacggacccgcaacactcagcgggaggccaccgggaccgggctgggcctggccatcgtggcggccatcgtgcgctcccacaacggcaccgtcgacgtgctgagcgaacccggtcagggcgccacgttccgcgtcactttgcctaccataaatgtcgaaaaaaggttcacagaaaacatccaggactagcacagtccggtacgagtagcacggggcagagtaatcaccatgaacgagaacgagaccaacccgcagcccgcggacgccggcgctgagcagttcagcacggagcgggtggagtctgagcagccgaccgcagcgcagccgccggccgccccgcagaacgccgctcacccgtccgcggctccgcagtacccgcagcagcccccggcgccgcagcacccccagcagccgcagcacccccagccgccgcacaatccttgggcgcagcccgtgccgggcggctaccagcagcccgccccgcagccgccgcacccgccccagtcgccctggcagcagccggtgtccgccgcccccacctcgggctacccccagtacgggcagcaccccggctacggtcagcagcccggctggcagcacaccaccaacccggagggcgtcgtcccggtctgggcccagccggtcgaccagccgccccgcaaccccggccgcggacgcaagttcgtgctggccggcgcggcggccgtgctgatcgcgctgctctccggcggggtcggcgccgccaccgcactggcggtgcacgacgacaacgcgccggccacggtgaagtccggcaacacctcggtcagccgggtggtggaccggtcgtcgctggcccagatcgcctccgcggtgcaggacagcgtcgtctccatcaccacccagtcgggtgagggctccggcgtgatcctcagcgccgacggctacatcgtgaccaacaaccacgtggtcgccaccgccaccggcgacacggtgaacatcatcttcgcggacggcaagaagaccaccgccaccatcgtcggcaccgacccgcgcaccgacctggccgtggtcaaggccaccggggtgtcgaacctgaaggccgccaccttcggggacagctcgcagatgcaggttggcgacaccgtgctggcgctgggcagcccgctcggcctggagggctcggtcaccgccggcatcatcagcgccaaggaccgcaccatccagtccagcagcgagcaggaccagcagggccaggggcagaacccgttcggccagtcgcagcagcaacagggcggcagcggcagcaccacgatgaccggcctgctgcagaccgacgccccgatcaacccgggtaactccggcggtgcgctggtcaacgtgaacggcgaggtgatcgggatcaactcggcgatcgccacctccggttccggctccggcaacatcggtctgggtttcgcgatccccagtgacaaggccaagaccgtggccgagtcgctgatgtccggcaagaaggtcagccacccggcgctcggcgtcagcgtcaccaccggggagaacggcggggccctggtcagccaggtcgtgtcgaagagcgcggcggacaaggccggcctgcagaagggtgacgtgatcaccaaggtcgacggcaaggacatcagcgagtccgacgacctggtggccgcggtccagtccggcacggtcggccagcagatgaccatcaccttcacccgcaacggcgccgagaagcaggtcaccgtcacgctcgccgaatcccagtagacctccaccgtcgcactacggcgggtgacgtggccagggggtgggcacgtcacccgccgtattccgctctatgccgctattcaggaccttcacgacgtacgggcaggattcaccgccggggactcgcgtttgctgaggggaccttctaatctctgaccgcccaccgtggcggagtgagaggccctgcgagttgacgtacgtcgagacccggaccagcgtctgggaagctttggccggccgggccccgaaagcggagtccggccccgccgactccgggctctggcacgccgtcgcggaccggctcaacccggctcgcgcccgtcccgaactgcggggcggcatcgaggtccggcaccgcaccacggtccgcggcgggcggtacgtgatgctccgttcgcccgaggagggcggccgcagctgctatctccggctgagcccggaggagtaccagctggccctgatgatggacggcagctgcacggtggcccggctggtcgccgagttcgcccggatcgccggccggctcgcccccgaccaggtccgccgggtggtcgccgacctggccggcaaccggatgctccaggagctgccccgggacgccttccgtccgctgcgcgagatgcgcccggagccgctgccgcagcgggtcggcggctcgctgctggccgccgtgcgcggccgccgggtgctctcggtgaacgtcgacggcacgctgaccggcctctacaacggcgccggccggctgctgttcacccgtccggcgttctggctgggggcgctgctgtcgatggccggcgcggtgctgttcctgttcagctgggagcgcggcaaccacccgctgttcctttcgggtgactcctacctactcggcgccatctcgctgctgttactcaacgtggtcgcgatgggcctgcacgagctgggtcacgcgctcgccgcgaaacgcgtcggccgtgaggtgccggccgccggcctgctgctgcacttcggcctgcccacggtcttcgtcgacaccagcgacgtctggatggccggccggcgggcccggatcgcggtcaccgcggccggcccggccaccggcctggccctggccggcctgttccagctgatcggcctgggcgtcccgctgctcggcggactcgccttcaagctggccttcctgttctacctgcacaccttcttcaacctcagcccgctgctgccgctcgatggtcaatacctgctgatggactggctggagatccccgacctgcgggcccgcggcctggcctggctcggtggccggctgcgccggcgcggtccgcgctggtcggtgctcgaccgggagggccggctgatcgccctgtacggcatgctcgccctgttctggctgggcgccgccgtcgcgctgggctaccggttgtggaccgaccgggtctccggcctggtcctcggcctctggtacgagggcctcggcgcccgcctgctgctcgccgtgatgctgggcggcctgctggccccgccgctctatttcctgctcggccggctcggcagcggatggcgccggtggcggcggcgttccgccgagcgcgaccaggaggccgacatgccgcaccgaatggccgcgctgcacgcctccgacctgggcggcctgcccgagccggcgctgcagtcgctggccgcccgggcccgctgggagcatccgcggatcggccggcagctggtactggccggtgcggagcaggccgccgtctacgtggtggtcgagggcgcgctgcacggccgtcgccccggcgacccgggcggcagcatccggcaccacgccggcccgggcagcgtggtcggcctggccgccgcgctcaccggccgcagcgccgcgctggactggcacgccgcctagctagctagcgcggccggcgccgtgctgctcgccgtccccacctcgacggtggctaccgtgatcggcccgctgccgggcccgccgccgcacgagcgggccgaggccgaggcgctgttcgccgacaccccggcgctggccggtctggaggaggaccagcagctcgcactgatcgccgcggcccacccggtggacctggagccgggtgccccggtgatgctgcacggcccgacccacgcggtggtggtcgagtccggggtgatcgccatgccggacggtgtcgagctgcgccgcggcacgctggtcggcccggtcggcgacggcacgccgggcatggtggcgcagacccgcaccccggtccggctgtggatcatcccggacgcgtccgacctgccgccgctgatcggcacggaggcccgcccgggtgcgccgatgccggcgctacggcccggttcgccactcgccgtccgcccgggcgccgtgcacccgccgctggcggtgccgcccggcccgccggacagcggtgacgagttcgacgtcgaccgccatttcgagaagcgcatgtgggcgttcgtcagcgtgctggtggtcgtggtgctcggcggcctcgggctggacctgagcgccggtccggcctgggccgagatgccggccgagaaggtgctgctcaccgtcgaccggggcagcgccaccgcgcggaacgagacgctcgccgtcggcgaccggcgctatctgggcgccggcgcctcggtcgaggcgcccggcaagtcgcgggtccggctcaccttcccgggcggcggggcgttgctgatctgcccgggcgcccgggtcacgctgacggcggccgcggtgggcggcggccggcaggcgatcccgtccggccgggtcaccctggagtccgggcgggtgctcgccgacacggccggcaccagcggcggttaccggccgctcgccctgaccgtcggccgtgaccagggcgacgtcaccagcgccggccgggcctggttctcggtcgacctggcggcggtcaccgtggccaccggcacggtcagcgcgggcggggtgccggccccggccatcggcggcgacctgagctgcggcgacgggcagaaggtgagccgaccggcggcccccgagggcggcgaaccgtccgaggcgccgttcccctccgacacggcctcaccgtcggcgtcggccagcccgtccgggtcggcgagtccgagcgccagcgcgtcggccggcgccgacccgtcgccgagcgccagccggtcgccgagcgccagcccgtcggcgaagccgagtgtcaagccgtccacccggccgacggtgcggccgaccgtgcccacggtgccgacgaccgtgcccaccacggtgcccaccacggtgccgacgaccgtgcccacgacggtgccgacgaccgcgcagacgaccaccccggataccggcggcaactagaagagaccggcggcaactgcaggagagaggcggcccgcccgtgctgtgctggttctgcgccgagagcgcccgggccacgtgccgtttctgcggacgtggcgtgtgcaccgagcacgcccgtttcgggccgtacctcctggagatcagcaggtcggcggtgcgggaccgggccgaggcgctggtggtggaggacgcggtgcagtgcggcacctgccatccccgcccccagccggtggcgatgcccgagctggattaggaccgcgagcggccccgtgaagcgcgtgtcacgatggggcgcatggtcgacggtccggtggcgttcgtgctcggcggtggtggcgtgctcggcgcggtcgaggtggggatgctgcgcgcgctgttccgggccgggttccggcccgacgtggtggtcggcacctcgatcggcgcggtcaacggcgcgctggtggcggccgagccgggggaggcggtcaccgaccggctggtccggctctgggcgtccccggaggcggccgccgtctacggcgactcgatcggccggcagctgcgccggttcgcggcccgcacgcacctgcattcgccgctgccgctgcgccgtctgctggcgggggagctgggcgaggcggccaccttcgccgatctcaaggtgccgttccactgctgcgcggccagcatcgagcgggccgccgagcactggttcgacagcggtccgctggtcgacgcggtgctcgcctcgtccgcggtgccggggctgctgccacccaccgagatcgacggtgagcatttcgtggacggcgggatcgtcaactcgatcccgatcagtgaggcggtccggctcggcgcgcggctcatcttcgtgctgcaggtgggccgggtggagcggcagctgagcgtgccgcgccggccgtgggaggtggcccaggtggcgttcgagatcgcccggcggcaccggttcgcccgcgacatggcgtcgctgccggacggcgtacgcgtgcatgtcctgcccagtggcggcggcgaggtcggcgacgactccccatgggcctaccgcgacatggcgcgggtcggccggcggatcagccgggcctacacggcctcccggcgctacctggcggcgaatgtgcacccgctgccggacggcgagcggtgagtctgccgccggtgtgggcccggcgcctggtcatcgccccggccatcgtgctgctcgccgccggtctgctgaccacactgccggtctggctgcttctcgcgctcgcggtgtcgccactggtccccggccggttgcgggtgccgcggctggtcttcctgctgatcgtgtacgtcgtctgggacgccgccgcgctgatcgtgctggccgcgctgtggattgccgcgggcgccggccggtggatccgcggcccggtgttccagcgcgcccactacgtggtgaccggcgcgttcctgcgcaccctgttctggttcgcccgctggtcgctgcacctggcgatcgacgtggtcggcaccgacccggacaccgcccagccgggccgcccggagatcgtggtgagccggcacgccgggccgggtgactcgttcacgctgatccacgccctggtcaactggttcgcccgggaaccgcggatcgtgctcaaggccgccctgcagtgggatccggcggtcgacgtgctgctcaaccggctgccgaacaggttcatcaccccgggccgtaccgccaccgaccggttggcggaccagatcggtgagctggccaccgggctggacgacaacgacgccttcgtgatcttcccggagggcggcaacttcacgccccgccgcagggtcaaggcgatcgcccgactgcgggccagcggtctggacgagatggcggtcaaggcggagggcctgcgcaacctgctgccgccgaaaccgggtggcctgctcgcggcgatcgacgcagccccggacgccggggtgatcttcgtggcgcacaccggtctggaccggatgatcacgatcggcgacgtgtggcgcgagctgccgatggacaagcgtctggtgatgcggttctggagcgtcccgccggaggaggtgccggccggcgagcgggagcggatcgactggctgtacgcctggtgggcccggatcgacgcgtggatcgaggagaaccggccggcgccgcggccactgtggatcgaccgcggcaccgcccggtgaggaccggctacttgccgcccagcgcctggtagacgctgtccggcgcctcgctgatctgaccggccggcggccgctgcgcggtcaccgtctggccgtaatcggagtacttgacctgcagcggcgcggtctcccggctgtccaccgagggcagtcgcagggtcagcgactccagccggtcctgctggtccagggtggcctcgaacggcacctgcttggcgtccgcgccgtacccgtcgagggtgaccttgctgatcccggccacgccggccgctttggtgaggtccacggtgccggcgtacgagccctccccggcccggtgcacgtcggtggtggagctgagcagctgcgcggtgttcgccgggtcgatctggccgggcttgaggccgatgttcgagccgtccggcagccgggccatgtccaggtgcgtccagttctggccctgcgtcacgccggggatctgggcgtacaggtccttgccgaacagcagcgtcttcacggtcagtgcggtgttgccgcccttcgcgttcatctccgcggtgccgttgccgtgcggcgcgtcgatgtccgcggtcagctggaatccgctgccctgcgtcatggtcatcttgaagctgctgttcccgagggtgctggccgcgccggacagggcctggaccgccgccgggtccgcgctggccgagggcgccgccgcggccgaggccgccggggcactggtcgccgaggtcgccggcgtgccgtccgcggtgcagcccgccaccgcgaacgccgccgtggccacggtgagtgcgagccgtgtagtccgcatggccgtcctttcgtcgcatcaaagccgtcgatggcagagttgcccgatcgtgggaacgggcaaacggcggccggatgcccggttcgccggtgggatctcttccggggcatgatgagtcggagctattgcgaaagacagggggaggactcgtgagattcgaggtcagcaaggtcctcgacgccatcgaggcccggctcaccaccgatccggcgctcgcccgggccgtggtcgatctgtcggaggtggtgcggtacgccgacctcgacgggggccgtccggccagcctggtccggctcggcctgctggtcgacgccctcgggcgctacgtcgccgaggagaacgttccggtctacgtgatcgccccgcgcggcctgctctccgacaccgacctcacgtcgaacgagcgcatggtcgtgcgccgctgggccgacgacggcaaggtcgaggtggtcccgcagatggacgaccgggtgctggaggtggccgagatgctcggcctgccggtgctcacccgtgaccgggaggaccgtttccggcagacccgcccctgggtcgccgagccgggccggctgctcgcgctcgtctcccagcagggcggccccacattggtcgcccgggtcggccggggcgaggcgatcccgcccacgccgcggtcgccgctgggcgagcggctgctggcccggatctggaagtgccccgacttcaactgcaccacgttcggcaccggcggtgactcggacagcccgttcgccgacatgcgcaccttcaccagcccggtcgcccagccgccgccggccctgcgcgccggcgtgccgacctgcccgcggcacggcgagcggctcaaggacgccggcccgcggccgcacaccgaggtgctctcggtccggatcgacggggtgatccggcagcggttcaccgtcgccgaggatcagccggtcgtcgtcggccgcgcgccggagggcggcggcggagtgatgctgggccagtggctgaccgcggacgcgcgcaaatggatcagtcgcggtcacgtgcggttcgcgctgcgagccggggagatcaccgtgaaggacatcagcaccaacgggacgggggtccggcccgggggttcgcaggatgacgaggagcggatcacgctgcaccgggacgagagccgggtgctcgcggccgacgacgtggtggagctgtacgcgggggtgcacgtggggcgcgccaagctgtgggccaacggcggcgtcatccaaccacaatcggtcatggccgaggccccgaccatggcgatccgccccgtcggaagatagatcaaacgctagatcaaattcatgatgtcgcacgctgcggccgataaccgatcgctgctcccgccgcttccgggcatggcgattttggccgctgcgcgtccagggcaaaccgccatgccctaccacccgcgtgtggtcacggaaaaccaaaaggcgccactgccgagcagtggcgcctttatcggtgagagatcagcctgccagcacggcggccagttgggcgaccgcgtggtccaggtcctcttcggtgatgaccaggggcggcgccaggcggatcgtcgagccgtgggtgtccttggccaggacgccgagggcggcgaggcgttcgcaggcctgccggccggtcatcagcgccggatcgatgtcgacgccggcccacaggccccggcagcgcaccgcgaccaggcccttgccgatcagcccttcgaggccggcccggagccgctccccgagccgcgccgagcgctcctggaactcgccggtgcccagcagcccgaccaccgcgctgccgaccgcgcaggcgagtgcgttcccgccgaaggtcgacccgtgctcgcccggcttcagcacgccgagcacgtcggtgttcgcggccaccgcggagaccggcacgatgccgccgccgagcgccttgcccagcacgtacatgtccgggacgacgccctcgtgctcgatcgcgaaggtcttgccggtgcggcccaggccggactggatctcatcggcgatcatcagcacgttgttcgccgtgcaggtctcgcggaccgccgcgaagtagccggccggcgggatcagcacgccgccctcgccctggatcggttcgagcagcaccgcgaccgtgtccggcgtgatcgcctgggcgagcgcctcggcgtcgccgtaggggaccaccacgaagccgggggtgtacggcccgaagtcggcccgcgcctccgggtcggtggagaagctgacgatggtggtggtccggccgtggaagttgccgtccgccacgatgatctcggcgcgcccggccggcacgcccttgacctggtatccccacttgcgggcgaccttgaccgcggtctccacggcctcggcgccggtgttcatcggcagcaccaggtccttgccgcacagctcggccagcccgcggcagaacgcggcgaactggtcgtgcacgaacgcccggctggtcagggtgagccggtcgagctgggcgtgcgcggcggcgatcagcccggggtgccggtgcccgaagttcagcgccgagtatccggcgagcatgtccaggtagcgccggccgtcgacgtcggtgacccaggcgccctccgcctcggccacgacgaccggcagcgggtggtagttgtgcgccgtccagcgctccgcctcggccagcgcctctgcggtacggaattccacggtcgtcacgagcgcacctccagcgtgcagcacttgggtccgccaccggccttgcggagctcggagacgtccaccccgatcgggtggtaaccggccttgcgcagctcctcggtcaggtgcgtcgcctggaccggcagcaccacgttacggccgtcgctgaccgcgttgaggccgagcaccgcggcgtcctccgccgttgcgatgatcgcattcgggaacagctgccggagcacggactgcgaacccggcgagaaggccgacggcaggtacgcgatgttcgtctcgtccagcacgcacagcgccgtgtccaggtggtagtacgccgggtcgaccagctgcagggtgaccaccggacggcgcaggaactcctgggtctcggcgtgcgacgcgtgcgaggtgcggaaccccgtcccggccagcagcaggtcgccggcgagcaggatgtcgccctcaccctcgttggtgtgcttgggcatctcggtctcgaagcccgcagcccggaaccacgcggcgtacgccggcgcctcgtcggcccgctcggcgtcccggaactgcacgcccagcgcgcgcccgtcgacgatcgtgccgccgttcgcggcgaacaccatgtccggcaggccgggcagcgggtcgaccaggtcgacggtgtggcccagctcgaggaaggtccggcgcaggttctcccactggctgacggcgagcgcgttgtcgtacggcgctgtggggtccatccacgggttgatccggtaggtgacggcgaagtgggtgggccggcacatcaggtagcggcgcatggcggtcatgcagaaacggtaggtgcggatgaccttcgcgcaccccggtccaatcatgcgtccggcggcggatcgttgcgtgatcaccgcacccggcggcgaatcgttgcgggcaccccacacgggcgccgggagcggcgttttcacgcaactcccggcgcccgtgcgggtcgtccggcgaaccgccggagcccggcccggcgaaccgccggagattctcggtgcgggccggcggtgccgtcccgattccgaggggtgtcccgtcagcgtatcgctgtcggtaaatgtcgattacccgtcagaagcggttcgcaaactgtgcgtcaagccactcccgcagccgcgccggcggctgcgtgtcggtgcccagccagctcagctggccgttgagggcgagcacgccgagcacgatggcacccagcgagatgagcaggccgagcagcgcgtcggtcttgccggccacgtgctgtctgcgggtggcgttgaggccgatcagcgagagcagcagacccagtccggcgacaccgacgccgtatccggcgagcgggccggagagcaccagcgccatcccggcgacgctgacgatcaggccgagggtggccatcatgctgccgcgggcccggcgcaccggggcgaccggggtggccggcgcggccgggctgaccggggtgaccgggcggccgacggtgatcggcttgcgctcggccgcggtcggcgcggtcaccgtggtggccggcaccggcttggtgaccgcctgcgtggtgggttcgtcgtcgccccggcggggccgcaccgggacccgggccgtctcgtcggtatcggtcgtggccgtgcgcgagaaggtaggcatcctcacgtcagcacctccttgagcgggggagtcgtctgacgctcacatacccgggcggtggggaaatgacacgggggacgcacggccacgccgcgcgtcccccgtggagaagcctcagaccagcgacgacaccgcgttcacgtcggacgccttggcgatcacgtggtcgacgatgccgtagtccttggcctgctgggcggtgaaccagcggtcccggtcggagtcgcgctcgatctcctccgcggtgtgcccggtgtggaaggcgatccggtcgttcatcaccgtcttgatgtgcagcatgctctcggcctggatggcgatgtccgcggcggtgccaccgatgccgccggagagctggtgcatcatcacccgggcgtggggcagcgcgtaccgcttgccgggggtcccggcgcagagcaggaactggcccatcgaggcggccatgcccatcgcgatggtggccacgtcgttcttgatgtactgcatggtgtcgtacaccgccatcccggcgctgatcgagccaccgggggagttgatgtacagggcgatgtcgcgttccgggtcctccgaggcgagcagcagcatctgcgcgcagatccggttggtcacctcgtcgttgacctcgctgccgaggaagatgatccgctcccggagcagacgctcgaagacctggtcgtcgaaggacgcgccgccgccgcgcatggtcggttcaacactcatgggtcaaccctttcgcatccgctcttctacgtctcacaccctctctcacggggcgtgtcgaaacccagcgattcccctcagggcgaatccgctgacggcagaatgccccccgggtggcgatcatcacgtccggccgggtgggcccgggcggctacctttggcgcgtgccggagggacataccattcaccgcctcgccacccgccaccgcgagctgttcgccggcgcgccggtgggggtgaccagcccgcagggccggttcgcggccggtgccgcgctgctcgacggccgggtgctggccgacaccgaggcgtacggcaagcatctgctgcaccactacgagggtgaccgcacgctgcacgtccacctcgggctgtacggcaagttcaccgagggggagccgccgctgcccgacccggtcggccaggtgcggatgcggatgaccggcccgtcgcactggctcgacctgcgtggaccgaccgcgtgcgaggtgctcgacccaccctcggtgcagcggctgcgggcccggctcggggcggatccgctgcgtgacgacgccgaccccgcccgggcgtatcagaaggtcagggccagcaccaagccgctgttcgcgctgctgctggaccagtccatcgtggccggttgcggcctgatctacgccaacgaggtgctcttccgggccgggttgtcgccgctgacaccgggcaccgcggtcggccgcgagctgtgggccgccctctgggacgacctgcgcgccctgatgaaggagggcgtcgcgcggggccggatcgacaccgtgcacaccgagcacaccccggaggcgatgcggcgtgctccgcgcgtcgaccggcacggtggcgaggtgtacgtctatcggcgcactgcccagccgtgcctggtctgtgccaccccggtcgcgatcggcccgctggccggccgcaacctgtactggtgcccggcctgccagagatgactactcggtcggggccgccgacggggtgaccaccgggtcggcgctggtgctcggcgccggagcgggcgtcgacggcgccggggtggccggcttggcggtggccggggtctcaccggtgccggacggcacccccagctgatagttctcggtcagccagggcagcagttcccggtacgccgcgatcgtgtccggctggttgaagtcgtgtgacagcacgatcgcgcccggcttgatctgcttcctgatcgacgcgaccacccgtttgacgtgcgccgcatcgctctcgccggtcaggtgctcccagtcgcgcgggtcgaccgcccagtacagcgaggacatcccgtcggcgtgcgcggtctgcaccagccggtcgttgaagttgccgccgggcgcccggaagaacgggatcgccgcgtccggcaccgcggcccggatcgccgcgttcgtcttctccaggtcggcccggatcttcgcgggtgtcttcttcgcgatggtcaggtcgtggtcgtaggtgtggttgcacagcgtgtgcccggccgccacgatctgccggaccatctccgggtgtctcgccacctgggagccgaccaggcagaacgtcgccttcacgtggtactgctcgagcatcgccaggatcttcggcgtctgctccgggtcgggtccgtcgtcgaaggtgagtgcgaccgtctggctgccggtggtcagcagcgaccggccgggaccggcgccggcggccggcgggagctgctgcgattcgatcggcttgccggtgaccgccgccgacggtgtgggcttggcgccggccgcgggctgcgcctgcggtccgcccggccggttgccggagtcgttcgtcctatcgtgctgaccggcggcccgcgccgaggcctcggcctgcgcggcggcggccagcgagcccgggtcgctgtggccgggctgggccagcggcaccgcggtgatcagcaggccggccacgaccagggtgccgagcaccgtggtcggccggttcttcgccgcctccagccaggtctccagcggcagggtgccgggcgcgcggtgggtgccggtggccggccgccgggggcgggatcggccgggggccgcggagtgccgtggcgctccggcggcagaccggacggtgctgtacgacccggtgtcgccggcccggtgccgggcggcacggggcgcgggcacgggcgacggtgcatccactgtggagcgcagcgccgggcccacggcgaggtccggccgacggtgccgcccacccgtcgcggctgcgtcgccggggctcgtcaggtgcggcgaggtgtgcggcggcatccgtcatgcctaccgtgcggcaagatcccgcgcgataccggatcggtcaccgaaccctcactgaaagttgtttttgctggtcacttgccgtgccgctgtgggcaatatctgtcattctcccccgcgggtggcgcgcgccagccagtccaccaccccggccaccggcacccccttggccagcagcgcccgctgccgtgccgcgccggtgccccgggtccgcagccgctccagcagcatggtcaccatctccaggtcgccgtgccgctccagttccggccggacgaagtcgaccagctgacgcagcagccgccaggccgggcgcggctcccgggtggcgaagtccaacccgaggccctcgagaccgtccttggccgctcgccagtgcgccgccatcagcagcgggtgcggcacgtccggcgccgggacgccgtcgcgcacctcgttcagcagggtcgagaccagcccgcgggccagcgcggcgagcaggatcgcgtcgtccacggtgggcatcacgtcgcccatccggatctccacggtcggataccgcgcggagagccgggcgtaccagtagagcatcccctcgtcgagcatcgccccgctcgcctcgaggtcggcgatcagcgtcaggtagtgctcgtgtgaggtgaggtacggggtcgggcccaccgtcggccagcgttcccacagcatcgagcgccagctggcgtacccggtctcccggccgccgaacagcggcgagttcgcggtcgccgcctgcagcaccggcagccacgggcgcagatgattgagcacctgtacgccggtctccgcatccgggatgctcacgtgcacgtgtgtaccgcacagcccctggccgggtgagagatcgccgaagcgctcccgcatccggtggtaccgcgggtcgtcgaagagtcgggtgttcggcccggcggccgggcccgcgcccaccgccagcagccgtgacccggcccgctccgcggcggtggcgaccgtttcgcgcagcccggtcatcgcctcgtagaggctcatcagctccagctggggcggactggccacctcgatctggctgcgcaggtactcgtgctggacgccgccccggaactgctccgggatctgctccagcaccgcctccacggtttccacgccgcgcggttcgaccgcgtcgaccagcaggtattcctcctcgaccccgagcgtgagcagatcgcgcttctcggcgcgctcggcgagtcgggcagagatagtcgtcgtgccctcggcagcggcttccatgcgcgacgggttacccgcccggtttgccggcaaaaccgggccttgaccatcggcgttacgctgccggacatgctgcttctcgggtactgggcgctggcgggcaccgccctgctcgaccccgggctcagcagcggcccgcgactggtcgtcgcgctggccctggtcgcggcggccctggtggtggccgccgtggtcgccgtcccggtgccggccgccggcctgctgccgggggtccgggcgttcacccgccgggtccgcaccgccgccccgcgcctgctcgacccgggcgcctccggccgtccccgcccccgagcacccaccgcgtaccccgcggccgcgtaaccgttccgtacgccgccgcctcggtgtccttcccgtttcggacccttggggtatcgccatgtccatttccggtctcttccacgccgtcgtcgacgccgcgcacaccggcatcaccgtcctgtccgggcatctcgaaccgctgaccggcgggctcgccgcggccgtcgcgatcgtcctgttcacgctgctcgtccgggccgccctgaccccgctcacctacctgcagatccgcaccgagcgccgccgcgccgcgctggcgccgcagatggcgaagctgcgggccgagcacagggacccgatggagctcgccaccgcgaccctggcgctgcagcgcgagcacgggatcggcccgttcgccgggctactgcccgggctggcccaggcgccgttcttcatggtcatgtaccgggtggcgctgcatccgccggccggcgcgatcgccggggtgccgctgaccgcgcacctgtccgccgggctgccggtcttcgccgtgctgctggcgatctcgggcgggatcgcctggtggtcgtcgcgccgggcggccgccccgcagccggtcccggtgccgggcgacgaccagcaggcggccgcgctgaccgcggggatgctgaggtacctgccgtggctgaccgtgctcgcggtggcctggctcccgctggccggcggcctctacctggtgacctccgccgcgtggaccgccggtgagcaggtcgtccggcgccggctggtcgccgccgcctgaccgggaagtccggcggccggagctggtcgccggacgcaaatatcgacagattgacaacttctcgaaacaagcgtgaaatcttctgagagcgctctcacgttccttctccacccccaggaaaggcgtgtcccccatggcagcttcccggagagtcctcgcggtcggcgcggcggtcctgaccgtcgccgcgtcggtcgccttcgtatcgcaggccgaggcggccgtccccgccccgccggccggcatgtccctggtcttcagcgatgacttcaccggcgccgccggcaccgggctgaacaggtcgaactggctctacgacctcggcaccggctatcccggcggcgccggcaactggggcaccggtgaggtcgagtcgatgaccgactcgaccgccaacgtctaccaggacggcggcggcaatctggtgatcaagccgatccgggacgcgtccggtcaatggacgtcgggccgggtggaaacccagcggaccgacttcgccgccccggccggcggcagggtgcgcatcgaggcccggctgcagcagccgaacgtgagcggtgcggcggccgccggttactggccggccttctgggcgctgggcgcggcggcccgcccggtcggcgccaccaactggccgagcatcggcgagtgggacatcatggaggacatcaacggccggtcgtcggtcttctccacgctgcactgcggcaccccctcgggcgggccgtgcaacgagacgaccggtctgggcagtggcgagcgggcctgcgcgggctgccagaccggtttccacacctacgcggtggaatatgaccgcagcacctccccggagcagctgcggtggtatctcgacggcgccaacttcttcaccctcaactcgtcccagctggacgccaccacctggaacaacgcgacccaccacgggatgttcgtgatcctgaacgtggcgatgggcggcggcttcccggccgcgttcggcggtggccccaccgcggccaccgcgtccggcgtgccgatgctggtcgattacgtggcggtgtaccagtccgccggtggcacgacgccgccgaccagcacgccgccgaccagcacgccgccgaccacgacgccgccgagcgggtcccgggacgcgtatgcgcagatccaggccgagtcgtacgacgccgccgccggggtgcaggtggagacgtgcgccgagggcgggcaggacgtcggctacctcaccaacggtgactggatgcagttcgacaacgtcgacttcggcaccggcggggtgaaggacttcgtggcccgggtggcctccggggcggccggcggggtcagcggcctggtcgaggtgcgggtggacagccggaacaacgccccgatcggcaccttcgcggtggccaacaccggcggctggcagtcctggacgtcggtgccgggcaatgtggcgaatgtttccggcagtcacacggtgtatctgaccttcaccagcgggcagccggccgacttcgtcaacgtgaactgggtccagttccgccggtaatactttttatcgaagatcgcgcatggaccgtagccgctgacctgcggctgcggcccatcgtcatgtcgtgatcacggatcgagttttaaagatgtttaaggttcccgacccctttacatttactgttaacagtcctaaagattgacgtatctcaccggaggcgcatggaaggacagctatgaagcgctcccgatcggtacttctcgcgacggtcgccgtggtggccgccgccggtacggccacctggttcgccggcgacgcgtccgcggcggcggcctgcgccacggcgtggagctcgtccgcgacgtacgtcaaggacaacgtggccgcgcagaacgggcacaactacacggcgaagtggtggacccagaacgagtcgccggccacccacagcggccagtgggacgtctggctcgacggcggcgcgtgcggcggcacgacgacaccgagttcctcgccgagcgcctcgccgaccacgtccaagccgaccaccccgcccgcctcgccgtcgagcagcccgaccggttccccgacggtccagccgaccggcaccggcagcctcccggcgcacttcctcaccgggtactggcagaacttcgtgaacggcgccacgccgctcaagctcgccgctgtcccgagctcgtacgacctgatcgcggtcgccttcgcggacgccaccgcgactcccggcgcggtcagcttcaccctcgacccgggcctggccggtgccgtgggcggctacaccgacgcgcagttcaaggcggacatcgccaccctgcactcgcgcggcaagaaggtgatcatttcagtcggcggggagaagggctcggtcagcgtctccagtgacgcggcggccgccaacttcgccgactcggtctacgcgctgatccgggcgtacggcttcgacggtgtcgacatcgacctggagaacgggctcaacgccacctacatggcgagcgcgctgcgtaccctgcgcggcaaggcgggctcgaacctgatcatcacgatggccccgcagaccatcgacatgcagagcaccggctcgtcgtacttcgcgctggccctgtcgatcaaggacatcctgaccgtcgtacacacccagttctacaactccggcgcgatgctgggctgcgaccagatgagcgcgtacggccagggcaccgagaacttcctggtcgcactcacctgcatccagacccagggtgggctgcggcccgaccaggtcgcgctcggcctgccggccaccacccaggccgccggcggtggctacgtcgccccgtcggtggtcaacgcggccctcgactgcctggcccggggcaccaactgcggcaccttcaagccgccggccacctatccgggcatccgcggtgcgatgacctggtcgatcaactgggacgtcagcaacggcaccaactgggccggcaccatcgctccgcatctggccaccctcccctgatccctctcacccctggagacatccccatgcgtacgagtaggaagatcgccctggtctccgccgtgctcgcggccggaaccggcgcggccgtgctcccgatgaccttcgccaacgcggccgccgcctgtgccccggcctggagtgccggcgccacctacgtcaaggacaacgtcgcctcgcagagcggccacaactacaccgcgaagtggtggacccagaacgagtcgccggccacccacagcggccagtgggacgtctggatcgacaacggcacctgtggcggcaccaccaccccgcccaccacgaccccgcccaccggtccgaccacccagccgccgacgaccggcaccaggatggcctcggcgccgtacgtctacccgggctggggtaacccgccggccccggcgaccgtcgtcaacgcgaccgggatcaagtcgttcaccatggcgttcgtcctggccagcggcggctgcaacccggcgtgggacggcgagtccggcctcaccggcggcgtgcacgccagctacctttcgcagatcaaggcggccggcgcggacgtcgtcccgtcgatcggcggctggagcggcaacaagctgggcccgaactgcaccacggtggacgccctggccggcgcgtaccagaaggtgatcagcgcgttcggtctcaaggcgatcgacatcgacatcgagaacaccgacgaattcgagaacaccgcggtccaggaccggatcctcggcgccctgaagatcgtcaaggcgaacaacccgtcggtgaagaccatcgtcaccttcggcaccacgccgaccgggccgagctactacggcacccggctggtccagcaggccaaggcgctgggcgcgaacatcgacgtgttcacccagatgccgttcgacttcggcggcggctcggacatgtacgccgccacggtcggcgccaccgagggcctgaagaacacggtgaagagcaccttcggctacaccgacgcccaggcgtactcgcacatcggcatctccggcatgaacggcctttccgaccagcaggagaccaccacggtcgacacctggacccggatccgggactacgccaggaacaacggcctggcccggttcaccttctggtcggtcaaccgggaccggggctgcgccggcggcggcgtggtctccgactgctccggcatcgcccagtccgactgggccttcaccaaggtcagcgcgggcttctgaaccactcgtgagtaagggaagggcggccccacggggccgccctttcgttatatgccgatgatcggtatattcctcgcccatgagcaatgtgcccctgcgggagcccacgtttctggtgctcaccgccctggccgcggaaccccggcacggctatgccgtgatcgaggacgtggcccagatgaccggcggccggctgcggttgcgtgccggcaccctctacaccgcactcgaccgcctgcgccaggacggcctgatcgaggttgaccgcgaggaggtcgtccagtcccggctgcgccgctactaccggctcaccggggccggcgagcgcactctcgccgccgagaccgcccgcctgcgcgagcaggccaccatcgccgagcgccggttgaaggttcgtcgtaccaacctcgggggagccaccgcgtgaccactctggagtcccggtaccgcaggctgctgcggatctacccggcgacgcaccgggccgcctacgaggacgagatgctcggggtgctgatggccggctccccgccggatcgtcgcttccccggcccggccgatgcggtggacctgatccgcggcggcctcacggcgcgtctcggtcgggcacttcaaggacggcacggtacgggctggcgcgaggccgccgcggtcaccggcctgttcaccgcgctggtgatggtcagtgacaacgccggcaccctgatcagcggcctgctcgagatcaatctgtacggcgacccgatgcgggcccacgggctgaacgacgccctgctggccgacccggcgctgcggttgctggcctggctcgccctcgccgtggccgcgctgtccggccgtggccgggccgccgcgctgctgtcccgggtggtggtggcggcagagctcaccgcggtcctctggtgggccggcatggacacggcggtggcgatccggctgtcctgggcgccggttgtcgcgatcgtgaccgcgctgctgttcggcatcgtccgcccggcccgcccggtccgtgaggtgctgccccgccgcagcggtctgctggtcgcggccgcgctgccggtgatggcgctggccgagggggtgctcacgattcccgagctggcctggaggttcccgtacgggctccggacggtctgggcagatctgccgttggtgctgctcgtggtcgcggtggcgctgatcggcgccccggtccgcggtcgggtcgtggtgctcgggctcgccgtctgcgtcgggccggcggtcttcctgggcgtcggggagtcgccggcgctgccgccgctggtgctggtcctggctccggcggtggtcctcgcggccggcgtcgtcgcgctgtcgcgtgccgaacgttttgcggcccgccggcgcggagaacaagggggccatgagtgaccggtggtatcagaaggcggtcgtctactgcctcgacatcgacacgttcgccgactccaacggtgacggctgcggcgacatcccgggactgatcggccggctggactatctggcccggctcgggatcacctgcatctggctgaacccgatccacccctcgccggaccgggacgacggctacgacgtcgccgacttctacaacgtcgacccccggttcggcaccctgggcgacttcgccgagctgctgcaccaggcgggcaaccggggcatcaaggtgatcatcgacctggtggtcaaccacacctcggacaagcacccctggtttgtctcggcacggtcgtcgccggactcgccgtaccgcgactggtacgtctggagcgagaccgcaccgccggaccgcaagcagggcatggtcttccccggcgagcagtcggagacctggagtttcgaccggaccgcgaagctctggtactaccaccggttctacaagttccagccggacctcaacatcaggaacccggcggtgcgcgaggagatcaagaagatctgcgcgttctggctgcagctcggcgtcgccgggttccggatggacgcggtgccgttcatcatcgaggagacggtgcccggcaacccgaacccggcgaagaacttcgagttcctcaccgaactgcgccagcacgtgcagtggcgtaggagcgacgcggtgctgctcgccgaggccaatgtcgagccggcccagctggtcacctacttcggcgacgagggtggctcgggcaaccggatccacatgctcttcgacttcatgctgaacgccaagatggtgctggcgctggcccgggaggatccggagccgatcatcgacgggctgcgcgagacccccaagctgccgccgggcggccagtgggccaccttcctgcgcaaccacgacgagatcgacctgtcccggctcaccgccgagcagcggcaggacgtcttcgaccggttcgggccggacgagaacatgcagctgtacgggcggggcatccgccgccggctcgccccgatgctgggcaacgaccggcgccggctggagctcgcctacgcgctgcagttcagcctgcgcggcaccccggtgctgcgctacggcgaggagatcgggatgggggacgacctggccctggagggccgggacgcgatccgcaccccgatgcagtggtccggcatgccgaacgccggcttctccaccgccgacccggccgacctgatccggccggtggtgatcgacgacggatacgggtacgagaagctcaacgtgaccctgcagcggcacgactcgaagtcgctgttggcctggttcgagcggatgatccggacgctgcgcgaggcgccggagatcggcagcggggcgtgcacccacgtcgacgtgccggcccccaaggggctgctcatccaccgtgccgacgacggcaccggcaccatggtcttcctgcacaatctcgggccggacgcggtgaccgccgacctgagcagcctggccgcggagtccgagctgcccaacgacgtgctctccgacaccgaatatccggatccgggcaagctgaccgagctcccggtgtccggttacggctatcgctggatccgcctgcgcaggaccgcctgattcggtttagagtcagccgtcggagcagcagagatcaccatgggaggccgcaatgtcgcagtccgcatcgtccagggtcgccatcgtcaccggagccgcgcgcggcatcggcgaggcgatcgcgctcaggctcgccgccgacggcctggccgtcgcggtcgtcgacctggatgagggcgcctgcgccaacacggtcaccgcgatccacgacgctggcggcaccgcggtcgcgatcggcgcggacgtcgcctatccggctcaggtgaccgccgcggtcgagcgggtggtggccgagctcggcccgccggccgtgctggtcaacaacgccggtgtgctccgggacaacctgctgttcaagatgagcgaggacgactgggacaccgtgatgtcggtgcacctgaagggttcgttcctgttctccaaggccgtgcagaagcacatggtcgacgccggctacggccggatcgtcagcctgtcgagcacctcggcgctgggcaatcgcggacaggccaactacgcggcggccaaggcgggcctgcagggcttcgtcaagacgctcgccatcgagctgggtaagttcggcatcaccgcgaacgcggtggccccgggattcatcgtcaccgacatgacccgggccaccgcggcgcggatgggcgtcgacttcgccgacttcgagaaggcgatgatcggtcagatcccggtggcccgcgcgggccgtcccgaggatgtggcgaacaccgtctcgttcctggtgagcgagggggccggcttcgtctccggccaggtgatctacgtggccggtgggccgagggactgaggctggcaacttgctgagaacggctacaaagaagtgatgaatcggcgcatgagctcccgcagcgtgtcgttgaccagcacgttcctgatgctggcggccggcggggcgtcggcctgcagcaacgaccgctatcacgacgagggtttctactgcgccgatgagaacggcgtcatcgtcgacgaggactactgcgacgaccacaacggcatctatcacggcggcgggccgtactacatctaccactcgccgagctaccgttccggctaccgggtcggctccaagctgccctcgggcggcagccgcttcccgtacaacgactccggctcgcgcagcacgtacgggctgccgtcgaccggccgggtcggcaacggcacggtgaagagcggcgtggtcggcaagggtggtggcggcagccactccagcggacacggctcgtcgggcagctgaggggaacatgcgacggattccgtacgggccggtccgggacggttggcggctgaccaatttcagtctcggtctgacctacaacgacgacctcctgccggacgggacgatgtactcgtactggcaggagggcccgtactacgacttctccgccgacgagatcgaggaactggagagcgccaccgccacgctgtacgacatgtgcctgcgggccggcgactggatggccgggcagtgcccgcggcgtaccgtcgagggtcgccggcgtggcttcatgacctcgatctgcacggccgaggcgtgcttcctgacccggatcgggatccccgagtacacccacgagcagatcctgcggacctggttcgacggcgacgcggagacgtggacgcaccaggacaaggacccggacatgcggctgccgatgcagacgccggacttctcgccgaccgtctacgggcgcttcgacctctggtacaacggggccggcagcaccccgcgcctgcttgaattcaacgcgcagacaccgacctcactggtcgaggccgcggtcatccagtggcactggatggaccagaccggggtcagccggcacccgtggcggcagtggaattcgatccacgaccggctggtcggctgggaggccaccccggacggcgagccggccgacccgggcgcctggcggcgcaacatcgccaaactgcgcgaggcccggccctggctgccggagaaacccaagatctatttcgcgtacgagacgtcggagacctcgggcgaggaccggatgaacgtcgcgtacctgatgtccaccgccgaggaggccggcttcccggtggaactgatcgcgatgagccagatcggctgggacgtggccggcgaccgggtggtccacgtgcccgcccccggccgggagaacgaatcccagccgatcgacgtgatcttcatgctgtacccgtgggagtggttctggcacgaggagggcggcaaggcgttcttccgcaacatggccgacccgtccaagcggggcacggtctggatcgaaccgccgtacaaggccgccctgctcggcaacaaagccctgctgccggtcctgtggaaactcttcggcgatgacccggagcgggcgaagtacctgctcccggcgtacttcagcggatccaagggtgcggcgacgctcacctcgtacgccaagaaaccggtctggggccgcgaaggcggctcggtcaccctggtccgcgacgggacgccgatcaccgacaacccttcggagtacgggtcggacggcctctacgtcgtccaggagttgtgcgagctgccgtcgttcgacgggctggagggcaccgtgcacccggtcatcggttcctggctgatcgacggcgagcccgccggcatgggcatccgcgagggtctcggcgtcgagggcctggtcaccaagaacacctgcaacttcctcccgcacgccgtctcctagcgctcagtgcggaaacacccgcgggatgcgggtggtgaccccgtcgcggaaggcctcgatgcgggtgatcacctggcggcggccgacggtgttctcgatccggtccaggtagaggcagcgcgcggccagccggtccaggtcgacggtgaagtacatggccatcagcgggttgacgaacagtgcgctgccgctggtccgccgggtgaactggatgtcgccgcactgaccggcgagggcggcggcgatctgaccgttgacgatgctcggccggtccggcgtgttcttcgcggcgtcggcgaccgcctcccggtagaggaccgcctcccggctcgtccccgggatcgacagcgcgcccaggtaaccgccctcccggtcgagcgccgccaggttctccagcacctgcacgtggttgacgccgtgatacgcgtcgatcccgaagcccaggcaggtgaccagcttcaccggtacgtccagcgcggtcaccgccgcgacgctggtgagatcctcgaccggggtgcccaggctgtgctcgtcgccccggcagaggatgtcggtgccgccgtcgacgagcacgatcgcgtcgaggttcaggtgctcgaccaggaaccggtacgccgcccgcagggtctgcacccccagcggcggaaacgcgtacaccgtcgacggcatgtcgtgcgccgccagccacctggcgagtgtgccctccgggaaataccagtccgggctcgtcgactccggcgtcacggcgacgacgtgatcggcgatccaggactcccggtcgacgagttcgagctcggaaaacgacaggttcgcgaggtggacctcggccccgaccgcgcgcagcgcgaacgccagcggcaagccggcgtagacgtcgaagccgccgccggccccggcgatcaggatccgccgggcggatgccagcgcggcgaacagcggcggtgtggcgaggttcgtcacgcggccggaccgggcttgtggcgccagatccaccagaggccgatgaacggcaggaccagcggtacatagccgtagccgctgccgtagcgggaccagaccgtgtcgtccgggaacgccaccttgtcggcgatgctcagggtgccgacgatcagcacgccgagcagctcgatcgtgcagctgaccagggcgatcagccggccccgggcgccaccgcgggccaggcccacggtcgcggcgaggtacaccgcaccggccagcgcggacagcaggtaggccagcggggcctcgccgaacttcgtgctgatctggaccagcgcgcgagcgctcgcggagagcgcgaacgtcccgtacaccagcagcagcacccggcccaggccggtgccgagagcggcgtcaccggggcgggtcttcacgggggtctcgtcagacaccggtcaccgacgcgatctgctgcaggcgcagcactaggacgggcaggatgacggcgcccaccccgaggatcaggctcccccagcgggtcggctccagcttggccagccaggtggcggccggggcgaagcagatcgtggtgaccagatagccggcgaaggtggtggtgtccgccgggcgcgagccgtcgaacagaccgatcaccgcgaccacgaccaggaccgcgaccagagcgctgaacccggtcatggccagcaggtcgaggcggctgggcgcccggtcgagggcgctgcgcaggaaataccacgcggccagcaggagagcgacgacgatcgtcgccaccgagaggggaccgttcacccggcacaggttactgacgtgccggtgggctggtaacttccggccccggagatcctgaagaggacgggtgggcagatcgtgcgtttcggattgttcggtacgggcccctgggcgcacatggtgcacgccgaggcgctcgcgcagcaccccgaggtggagttcgccggggtctggggacgcgacccggcccgggccgccgagctcgcgggcaaacatcacacgcgggcgtacgccgaggtggacgccctgctcgcggacgtggacgcggtggcgatcgccctgccaccggacgtccaggcgccgatcgcgctgcgggccgcgcgggccgggcggcacctcctgctggacaagccggtgtcactgcgtaccgccgaagccgtggaactgaccgcggccgccgcggaccgggacgtggcatcggtggtgttcttcacccggcgcttcgtaccggagaccgagcggttcctcgccgaggcggtcgcggccggcggctggaccgaggcccggatcgaccacctcggttcgatcttcaccccgggcaacccgttcggcgcctcgccgtggcggcgcgaccgcggtgggctgtgggacgtcgggccgcacgccctcgccctggtactgccggtgctcggcgcggtcgccgaggtcaccgggctgtccgggccgcgcgatctgaccgtgctcgtgctgcggcacgagagcggggcgatcagccggctcaccctttcggtggacgcgccggccggcgccacgcgacaggccgccgagttcgccggggaggccggggtgtggccggtgccggccgtcgagttcgccgcggtggactgcttccgggcggcactggaccagctgctggcggccgccgcgggcgggccggccgcggccgtcgacgtgcgtttcggggcgcaggtcactgcggtgctcgcggccgccgatcaggccctggagcaaggccgggtcgtccggctctaggcgctaggggacggtgcgctcgatcgcggccgcgccgtcccgctccagctcggcgcgagcacgcgcgatgttctcgggcgtcggatacctgccctgggccacggccaggtcctcggggtcccagggctgctcggcgccggtgcgccagactggcggagtctcggtctcgtgcatgccctcattctgtatgccgggccggacggccgcgccggtttcgcgcggcagaagtgactgtcggccgaaacaggcgctaactggacagaacctgcgcgttacggatggacgcaaagtagcggggcgaatactttttctcctgtcacgcttgccaggggcggaccgtcccgacagccggctcccacgcggacgccgcggcaggcgtgaggtgaggggacagatctgcatgacgcaccgcaccgcagcccgacgaacgcgcgcacggctcggccgcaccggcccggcgggcatggcatgaccggcctctgggacgccgagcgggacgccggcgaggtgatgcgggccctgcacggcctggccgccctgctgggccgcgacccggacgaggacaccctgcggctgatgcgtcagctcgccgagaacggcgtctcctcggccgcccgggtccgggactacctgcacgagcagcgcgggcccggcgacggggacgcggccgtggtggcgtccgtgctggcaccgtggcgggagtggacgccgtcgcggggtcacctgttcggggcgcaccgggggagcgggccggtgggtgcccggcggatcaacgaggtgccgcagccgcgccgctgcgacccgggagagtgaatccgtcagccggcccggcgcagcgtctctgacggggagacgccgaaccgggtgcggtacgccgaggcgaaccgccccaggtgggcgaaaccccagcggtgcgccaccgcggcgaccgtgaccaccgccggatcggccacccgcagcgcctcgtgcgcccgggtcagccgggtctgctgcaggtaggccatcggcgtgcagccgacgtgccgccggaaaccctcctgcagcgaccgcacgctcgtccgggcgatcgcggccaggtcggccaccgtgaacgcccggtccggctcgtcgtggatgacgtccagcacccggcggatgctccgcggcggcccggcggcggccggcgcgaccaactcgtcgtggtagcggtgtgggacgctcagcagcagcccgctcagcacgctgctgcacaggtgctcggcgatcagcggctggaagatcaggctggatcggtgctccagctcggtgtggaccagatggatcagccgggcccagctgtgcgccgggccgccggtcagcgcgaacgtggccggcaggtcgatcgttccctcgatcgggtgaccgagcagcgcggccagttcactctccaaggcccagtgttcgatgcgcaggtcgatctccgtggacggcgcctcgggccgcaggtagaccggatcgccggggcggaacgcgacggcggtggccggtcccgcggtgacctcccgcccgccccgccgggccagcacccgcccggccaccggcagggtcacgtggtacgcgtcggcggccggtgcggcgagtgtcacccgcccggtgaaggtgagatgaccgacggtgaggggtccgagttggatcacctccatgccgatcttggtgtcggcgttctccggcatgcccagcgacaccgggtggtagaaacgatgcaggacgtcagccgcgtcttcggcggcgccgccggcgaagtggacgatgccgggcgccgggggggaaacggcgcccggggccgcgtcaggcatgccgctcggtgctccatcgcatacggtgagtattcggccagattcagtggacagtcaacgccgtcaccgtgcgctgaccgatccagcacattccggccatatgaactactctggcgttccgcgcctacgtggcgtaacttgcagaccagcggattgttgtaggaacgcgggttcctgtggcgtctcccagcgaacgccgcgtgcgagcgacctctatctccggccgtcgcatggtgtcccgcggcaagtcggcgtcggaccttccgacaccagaagagagggcagctgtgtatctgccgatcacgacccgccagctggccgacggcaccgtcgagatcgccccgagcggggaaatcgatctggacaacgcgcacgtcatgcgggacgccgtcaacgacgtcctgaccaccatgacacccagcaggatctgtctcgacctgcagcgcgtgatgctgatcgacagcatcgggatcggcattctggtggcctgcttccacaccgccgccgcgagcggcatcaagctggtggtgagccatcccagtgccacggtctaccggcagctctgggtctccggcctggtcggcctgctcggctgcgccgagccaccctccccgcgcacctcggtcgggctccgtccctcctgaaactccgcgggaatttcctggccggttttcacccctgcgggcgaagccggccgaccgattccgacaggaaccacagcactgacccgtcatcccccgtggctggcgggtcagtgctttccgaggaactccgcggtcacctccaccgcccggctgacgtaggcgtccacgtcgtacaggtcgacgtgccgggtgcagtccagccacaccgtctcgtcggcccgcatcgcctcggccagctccggcgagcagtagtcgtccacccgcccgtgcaccaccaggctcggcggcagcagcggccggaccccgagcacgtccagcgtcatcaggctgtgcagcgagccgcgggtcaccctgttccgccagccgtccgagccgatccacttcgagtagtacgaccacggctcctctcccggcatggccgcctcaccctccagggcgaccgccgggatctcctcgtcgtagcgctccagcatcccggccagcgccgaccggtacgacggcaggcccatccgctcggcgaaccaggccgggctgttgtacgccccggcgatcccgaccaccgcccgcacccgtggatcggtcgccgcggcccgcatcgcatagccggcgcccaggcagaccccgaccaccgaccggtcgtagccgtccagcacccccaccgcggcccgcagatcggccagcttgccctgactgtcctcatgcccgcggcggccctcactggcgccgaacccgcggtggtcgaacgtcagggtggtgatcccggccgcggtcagccgctccgcgtaatcggccaccacctgctccttgacaccggtgaacggtccggtcaacacggcggcccgggaccccggcgcggtccggagcaccccttcgagccgcagcccctcgctgaagaacgtcactgtctcggtcacggcaccacgctaggctgcgggggctacaccggagaagtaggcactttcgggtacccatctgggggcaggcgtggagttcttcgtaccggacgtcctcgacgaggggtgcgccacccggcaggccctggaacgcctcgccgtcaaatggcgggtgctgctgatctacgccctgagcgacgggccgcagcgtccggcccggctgcgccgccggatccccggcatcaccccgaaaatgctcaccgaaaccctgcgcggcatgcagaccgacggcctgatcctgcgccgcgtccacaaggccgacccgccacaacatgtggaatacgagctgacgccgctcggccgcaccctccgcgagcccctgaccgccatctgtgcctgggcccgcgaccacagcacccccgcgccgcccccggcgtcggccggcccggcgttcaccgcgccgcagccgtcggcgccgccgcaggacgccgtgccgacgcgggtcacgcggcgcgccccggtcagtcgttcagctgggtccgctggatctcggtgagggccgcggtgagccagtcccgcagatcccgccccgcgagcagatcggtgatcagcagcatggcgttgcgggccagggcatccggcttcggccccggcgcgccgtcctcgtcgaggacaccgagcgccccggcgagcagccagagcaccacctgcgggtccgcttccggatgggcccgcacgcaggacgccagcgcctcgcgcacatcgtcggcggccagcccgtccggatgtccgtcctccagcagcagccgcaccgtcgtcccgaggatcaacccggcatgcgcctgctccagcccggcgagctccgcgacggccgcatcgaatgcgacagccagatttccctgtacggcgtcaaccgccgcactggcagccaccgcgaccggccgcgccggagacggcagatgccgccagcttcccgtcatcccgcgaccctaccgatccgacccggccccaccccacgcgcagacaccccgttcggggacaccggcccgcaggcgctccactcatggacaccggcccgtaggcgtttcgctcacgggcacctcgggcccgcaggcgctccactcgcgcacaccccacttgcacacaccatttcgcagacacccgctcggtggatcgtgcggttccaggttcgccatcgctcatgggcgtggggatgcacggcggggttttgtcttttcggtgaccacccacggacaatgaagggtccggagattgttgtggacgcgccagcggccagatctccgggcccggcctcggcgggagcggcgatcagttatcagcgcggacatacgacatccagatgttgaccttgaccttgatggtgattagttcccgatcctcacctcgaccttgatcgaaacccgcggggagggtgtatgaccagcctggatgccgttgccgcctggatcgcgaagtaccgcaaggcgtgggagtcgaacgatccggacgacatccgcgatcttttcaccgatgacgccgcctacttcaccgccccctattcatccccctggcgcggccgcgaggccattgtcgccggctggctgaagcatcgcgatggtccgggcaccacgacgttctcctggcagccgttgatcgtcaccgaggaactcgccgtgatcgaaggtcgcacctgctatccggatcgcgaataccgcaacctctgggtactgcggctggatcacaccgggcaggcccggcagttcaccgaatggtggatgcaagccccgcagccgccggaacagtgacgcaccggctggacggcggtccggtcggtgaagcggagtcggttgcgggggcgccgggagtgcggtccggacgtcgagcggacggcggccggccgtggagcggagtcggatgcggttcggtcggtcggtcgcggcatgctccggcggtgcggtcagcggatggtgagcggcggcgcggtggccaccggaatcgtgaggcggcatccggccacgtcgatcgtgtggtgtgaggcggccagcccgccccccacccgccccgggttgcgggcgaagcgtgggaacgccccaccggagagttgcagccgcaggcggtggccggcgagcaaccggtggaagcacgggtcgagggtgagttccagccggtgcggctcgccggccgggtggccggggtcgaggcgccggtgctggtcggtgaagttgagggagcggccgtgcgggtcgacgtcgcagaggcgggcgaagatgtcggcgtgcgggttgtcgacggtgacggtgagcgtgagggtggggccgccgatcacgtcgacggcggtgggcaacgggtcggtggtgaaggtgaggacgtcggggcgggcttcgagggcgcggttgtccttgacgcccatcgagccggtgagggtgcggccgccgacggacggggtggggtcggcggggtcgtaggtgaaggcggcgacgccctcgtccgggccgggagcggtggtggtgaggcggcggccggagcgcaggtggaaggtggccggttcggtcgggggcggccaggcgggcagatcgtgccaggcgcgttcgccggtgcggtgcacccggacgggtgacttgcgggcggccgggccgccggccaggtgctggtcgagccaggccaggctctcccgggcgacgaggccggccgcgtgcagtccgacctgcagatgtgtccacgggccgacggtcagggcgacgtcgacgccgcggttgcgcagggcggtgtactgctggagggtctggtcgaggaacaggtcctgccagccgccgatcagcaggaccgggacggtcaccttgtcgagggcggcgccggcccggtacggggcccaccacgggtcgtcgccgtccgggtgggcgagccactgccggtaccacggggcccggccgcgcagcaccggctcggcggcttcgggcagggggaggccggccagggcgggacgcagccggcgcggggcggtggccatcgacagcacccggcgcaggccgccgtcctcctggtggacgatctggtcactccagccgaggaaatcaccgagggtgaaggcgccggtgccgtagacggcttcccggaagtcgtgcgggccgacgtagatcaccgcggtgtgcagctcgggcggcgggtcctggagcagcgtccactgggtccagcccaggtaggaggcgccgagggtggccagccgaccgtcgaaccagggctgctcgcgcagccaggcgacggtgtcctggccgtcctcggtctcctgggccatcggggtgaaggtgccctccgagccgaaggtgccgcgcacgctctgtagcagcacgtggtagccgcgggcggcgaagagccggccgttcagcgccgaggtgggcaggccgcggccgtacggggtacggatcagcacggtgccgcgcggccggtcggtgaccggggtgaagtggtcgccgaggaggcggacaccgtcgcgcatcggggtgcggacctgctccaccgagtacccgtgcagggcgggcgcccgaccgaacaggcggctcagtgccgcgtcggtcagccgttgccgtccggagatcgccatcgagccccccatcgccggattccgacgatatccacaccccgcggaatatgaaagatgaatggcattcgcaggatcgccgatgtgcgaatcggcgagcatttcggcaaactgcgtcgagtggacgagggacgcaaactcggtggccggtaccggctgctggacgaactcgggcgcggcgggatggccgtggtctggcgggccaccgacgaggtgctgaaccggctggtggcggtcaaggttctggccgggcggtacgccggtgacgaacggttccgcagccggatcctgcacgaggcccgggccgcggccacgttgtcgcatccgaacatcgcccagatctacgacttcggggaagacgattcggagaatcccgttccgtacgtcgtcatggaattgatcaacggaccgacgttgcagcagcgcatcgaggacgccccgctgccgccgcgccgggtgttccggatctgcggcgaggtggccgccgcgctggccgccgcgcacgaggacggcctggtgcaccgggacatcaagatggcgaacgtgatggtcaccccggccggcgccaaggtggtggacttcggcatcgccgcggcggccggcccggccgagccggaggaggggctgctcggcacccccgcctacctggccccggagcggctcaccggcggcgcgatcgagccggcgtcggacgtctacgcgctcggcgtgctgctgtaccgcctgctggccgacgagtcgccgtggaccgtggagacgaccacgcagatgctcagcgcgcacatctacgccgagccggccccgctgccggacctgcccggtgtgccggaggcggtcgccgacctggtcgaccgctgcctggccaaggagccggcggaccgcccgtcggcggccgaggtgtcggaggtgctgggcgacgcggcggaggcggtgtccccgccaccggcgccaccggccccgatgctgatgccgacgcggttcgacgagcagaccgaggcgatcgcggaggcccggcttccggtgtcagtggtccggccggtggccgcggatcggcgcacccgggtgctggccggcgtcgtgctggcgcttctgcttgtcaccgtgggggcgatctgggtcacccggtcggatgattccggcccgggcgggctcggcgccgggccaccggccagcgccggcgctagctagctagcgtcgcaccgcccggcggcggtggtcagtgacgtgccgtccagcgcgcaggtccgtccctccggcccggccgtgccgtccgcggttccggggccgggcggcggcggcagcccggcgccgaggacacggcgccggccggcacccggctggacaccaagggcggcttcgtgcacgccgcctgcgccgccgggaacgtccggctgctcgactggacgccggccgacggctacagcgtcgagcgggtcgatccggggccgggcctcaccgcgtcggtgaccttcgcgagcgatgtgacccgggaccggatgtcggtgacctgtttcgccggcagaccgtcggcggtggtcctgccgctataggagccgccgcaccggggacggggccgcggcgagcagggtttccgcggccgcggtgcgcgagttgagcagcgagcgcccctcccggtgggtggtgaccaggccggcggcgcgcagcacacgcaggtgctgggagacgccgccggcggtgagcccggtccgccgggccaggccggtggtggagcggggcacgtgcagttcggacaggatgcgggcgcgtccggcgccgagcagcgcgctgagcgcgtccggcggggccgccggggtctcggtgagggtggcgaccccggcggccgggtaggcgagttgcggggtgccccacgcggagacggtgagcaccgccggccaggcgaacaccgaggggatcagcaccagcccgctgccgtccgggacgtccgaggcggtgcagtgccgctggtcgaccaggagggtgccgccggtccagcggacccggtcgtgcaggtcgttgaggacggccgcggcgccgtcggtggccagccggtgggcgcggcggcggacgtcggcgtcgagcaggccgtgcatgcgcggccagtccggggcgatcgaggacgcccagtaggccgcgatctcgtcgcagagccgggccaggccgcggtccgggtcctcggcgagtccgggggccgggtcgcccgccaggagcgcgagatgggcacggacgacatcgtggtcggtctggcgaagaaccgacagttcggcgtcgaggtcggcggtcaggccggccggcggcggggtcaggaaatcgggggcgtagcccccggccggcggcaccaggcgggcgagcaggccgccgggccccggccggttccggtccgcccaccggcggtgtacgggatgatccccccgcccgtgcagcacccgcaggctggtcaccacctcccacaggcaggacacgccgaacctgatccgggtggcggcgtccgggggcaacgcgatcgcgaccatgctttcagtctgcgctaaatggttgccgccggagcgcaccggccgcgttgactcggtgccgtgaccgacttcactgccctgcatcagcccggctcgccgctcgtcctggtcaacgtctgggacgtggcgagcgcccggatcgtcgccgcggccggcgccgccgcggtcgccaccaccagcgccggagtggcctggagcctgggcgtgccggacggtgacgcgctcggccgggaagcggcggtggccgcggcccgccggatcgtcgccgcggtgtccgtgccggtgtcggtggacgtcgaggccgggtacggcgacccggcccgcaccctgcgcgagatggccgccgccggggtggccggggtgaacctggaggacggccgccgctcgatcgccgagcagaccgagcggctcgccgcggcccgggcggccgccccggcggtgttcctcaacgcccggatcgacacgctgctgttcggcctgggtgacgtgaccgaggcgatcgagcgcggccgggcctatcgggacgccggggcggacggcatcttcgtgcccggcgccaccgatcccgcggtggtcggcgcgctggtcgccgggatcccggggccggtgaacgtgatggccgggccgggcgcgccgtcgatcggcgagctggcgaagctgggggtggcccggatcagcctgggctcggcggtggcgcaggcggcgtacgggctggtggaccgcgccgcccgggaggccttcaccgggggcggctatgcggagctggcgggcgcggccgactacgggcggctgaacgagctcagtcgctgaacttctggaactggatggtgaactggtacgcggtctggatgatcccgctgcagttcgcggcgaccgtgccgttgccgcaggccccggtgtcccggttcaccgaccagaatctgacgaagccgacgcccttgctcttcgcccacttcagcaggtatgccgcgtcggccggcttggtcgtcccgccggtgccgttcaccccgatcatcggggtgacgccgaacatctcccacagctcctcgaccgacttgtccggccacacgccggccagggcggcccgggcggcgccggcggcgagcgtcatggcccggccccagccgccgccggccgcgttgaagttcatggtgagcgcgttgacggtgaccttgagcccggcgtccgcggccgctttgagcatggtgatcgcgtcgctgccgaagccggtgactccggcgaccggcagggtcagcgtgatcgcggtgtcccggtcctcctgcagctcggtgagcgcccggatcaccggctcgacggtgacctgctgctccaggtcgacgtcgaggcggttggcgccgaccgcgtcgagggctttgcggtacgcgccggccagctgctcctcgctgcagacgctctccaggtaggtgccggtcgggccgccggtggcgaccaccacgttcccgccccggccggtgatccggtcggcctcgccggtgaccgtggcgtcggccagcggggttcggccgccccacgcggggtcgcaggcgccctgtggtggcgcctgcagataggccagggtgaagtcggtctgtccggtggcggccaggtcgtcgatcgcgaccgggccggccgtcacgtcgatgtagggcgcgactctgagggtctccggccggccgccgacggcttcggcggtgacccggggttcggggccggggctcggcgggggagccgcctcgtgggtgctggagcagccgccgagcagcagggcggtgacggccacggcgcgggcggaacgttggagagccacccctgcactattccacctacgttgcccggataaatcggatgtattgggaatcggtagagggtgggtggctgcgcgaagtcggcgtgacgtccctgccccacggtgactattgatgtacgctccgcccgtgtccgaggacaagatcaacgatcgtcccttttatcgttccaagggattcgagctgctcgtgctcatcgtggtgggcgtgctcgtcgccgccggggtgcgcgcctacctgctgcagaccttctacatcccgtccgggtcgatggagaacacccttctcctcaacgacaaggtgctggtgaacaaggtcctctaccggttccgcgacccgcaccgcggtgaggtgatcgtcttccagcccccgcaggcctggggtgagggcgccgccgaccaggagtacatcaagcggatcatcggcgtcggcggtgaccgggtggtctgctgcgacccgcagaagcggctcacggtcaacgggcaggccctcgacgagccctatctgttccccggtgacgccccgtcggacgacaagttcgacgtcacggtcccggccgggcgcctgttcgtgatgggcgaccaccggtcggactccgccgactcccgcgcccacctggacgccgatcagggcaccgtcccggtcgaccgggtcgccgggcgggccttcgccatctactggccggcctcccgctggagctccctctccgtcccggacaccttcaagtcggtcccggacaagggctgaccgcagccctcccgacctcggcccgcgagcccgtcagccacccggctggcgggctcgcggtcgttcgcgcaccttaatctcctacctggccggtatgtgggatagatctcctttcatgacttggtcggcgttcggacatcgaagtccgacgaggcgcgttaccgtgtccgaagtagatcaggggactgtttgagaaacatctatctaccgatcggtgtattttcggccggccttccggcatcagtcatgtggtcggtaagtatttcaccacgcaagcaacacatgtgaatttgtacgtccttgaccggctcgccgatccgtcgctagtttcggtccgtaccgcaagtcgtccattgtggatcatgcgaatgatcacgcctggacccatcgggggagaaaatgctgacatctgtcacccgccggacaccccggtcccggtgccacccgcgcggcggggcccgtgaccgagctaccgggaacggcttcgcggcatgagcgccgaagccgtcttcgccgatgtgaccggcggcgcgagcgcatcgcagtgggccgcgctggcggggggacacctctactcgaccgaaccctggctgaccttctgcgccaccgacatcggcggcgagacccgcaccggggcgctgcacgtgggtaccggcgacaccgccgcggcggtcaccgtgaccgccgtcaccaccgagaacaactccttctaccagtggcaggaccagctggtggcgcgtggtctgcccgcgcccggcccggtcggcctgctggtcggccagcggcgcggataccagacccacctgctggcccggcccggcgccggcgaccacgccggcccgctgctggagagtctgcgcaaactgcgcgccgaggtgcccggcaccgaggtgctgcccaccgccccgcgcggcccggcccccctggtgggtgtcttcctcggcacctccgacgtggccgcgctgcgctccgccggggccgacgcgctgcccgtgctgatcgccacggacgcctggatcccggtggccggcggatggccggactatctgcggtccctgccctccaaaggccgtcgtgattcggtcaagcaggaggtgaaagccttcgccgcagccggttacgaattggtcgaggacaccctgccgaattcctatgtcacggcggccgggctgctggcacggacgcaggagcgatatggtcatccctatgacctggacgtgctgaccgagtcatttcgccgacaggccgccgcgatgggcgacaaagcgcgggtgttgtactgtcggttgccggggcaacccccggtcggctattcgcttttctacattcacggcgacacccttttcgtgagggccgtgggattcgcctatgaccggctcattcccggcgccgccgaatacttcaatctggtttattacgcgagtgtccggatcgccgccgagcacggtctctcctggatccatccgggcatcgagtcggccgacgccaaggcgctgcgcggggcccgcctgcgcccgctctggctgctcgacctcgccgaggacagcgtgctgcgggactccggcgacctgatccgggcgcacaacgccgccgtggtccgccgtctcggcgagtcatcgccggcggtcgccaaggccttcgacgccgaccagtgccttccgtactgctgatcccgtcccgctgctgaatcttccttcccgacagatcaccgactgatcggagtacttcgtcatgcccacttcagccctgctcttcatgggcgacctcgtggtgctggcccggcaggcccggctcatctcggacgccgcccgtcggggcctggccccggtcgccgtggtcggcctcggcaccgacctcggccggctcgacgcgctgcgcgccgacgccacccacccgctgtccgcgctcgccgaggtcgtccaggtcccggacgcctcgatcgccaccgtcctgcaggccgtgcagccgctgctgcgccgctacgaggttcgcggcgtggtatcggtcggcgaggtgttcgtcgagccggtcggcgtcctggccgattgcctgggcctgcccggggcgggcaccaccgcctcggtgatctgccgcaacaagctgctgcagcgcaccaccgtgccggagttctccccggagtacgaggcggtgccggccgatcggcgcgccacgttcaccgtcgaggccggccgcttcccgctcgtggtcaagccggccgggcggtactacagctccggggtgcgcctggtcaccgatcaggccgagctcaccgcggccctcaccgcgctgggcgacgacgagatcgccctggtggagagccgggtggtcggcccggagttctccgtcgaggcgatcgtgcagggcggcgtggtgctctggtccggggtcaccggcaaggagagcaacgagcacgagaccagctacttcaccgagctggcgcacaccagcccggcggtgctcgacccggacgaccaccacgcgctggtggccgcgaacaccgagatcatccgccgggtcggcctgcgcgacggcatcacccacgccgagtaccggctgagcagcgccggcccggtgctcatggagatcgcggcccggctgcccggcgacgcgatcaccttcctctgggagctggccaccgggcagccgaccgagatcaccatcatcgatctcgcgctcggcgtcccggccgcctacccggcgccccgccgccgcgcccgccagcacttcctctcccacccgcacggggtgctgggcgacgtgaccgccgacggcgtcgaggtcgtctggcccggcgtggacgaccgctggccggccttcaccccgcgggcggcggccgacgatccgcacacgcacgcggtcatcgtcggccggctgcccggcgacgtcctcggcgaccagatcgactccggccaccggtccgcctcggtgatcgtcgacgccccgctggacgccgacatcgaacacgccaccaaaaccgccgccggtcgggtgaccctcaccgtccggccggcctgaccaccatcgattcacgaaagggaagtgccgacaccatgtccaccctcaccgccacgccccactgcctggtctgtgacaccgccttcgacgttcaggacgactgggagaagggcgagatcgtcgagtgcgccgcctgcgggcaggaacacgaggtggtcgagcgctccgccgccggcctcgtgatcgacctcgcgcccgaggtcgaggaggactggggcgaatgagccacgaggtcctgctcaccgtcaccatgctgcgcccggaggagaagctgctggcccgcgccctgcgcgaccgcggcatcgaggtccgcaccgcgctcttcggtgacctggccgaggtggtctccggtccggccgcgccgcctccgctggccatcatccgcaacgtgtcgcaccgcgaggcgatcgacgccgcgcgccggctcgaacacctcggcgtcaccgtcctcaaccggccgtcggcgatcgagatctgcaacgacaagggcctgcaggcgttggtcttcgaccggaacggcatcgcccacccgaagaccctgcacgtcttcggtttcgaccaggtccgggccgccgtcgaggaggtcggctggcccgcggtggtcaaaccggtgagcggctcctggggccgcggggtgaccaggctgactgacgaggccggggtggccgcgtggatcggcggccgcgagtcggtggacgccgccggcaaggcgttcccggtactgatccaggcgtacatcgacaagcccggtcatgacctgcgggtcctcgtcgtgggcgaccagccactggtcgccttccggcgggtgtcgcaggactggcggaccaacacccatctcggcgccaccgtcgagcgggtcgaggtgaccccggagatcgccaagctgtgccgtctggtcgccgacgcactgggcgacggcttctacggggtggacctggtggaggaccggagcaccggcgagttgctggtgctcgaggtcaacgccagccccgacttcgcccgctcgtcccaggtgcacggcgtcgacgtggccggccatctcgccgactacgcggcccggcgcctggaagccggggtgccggcatgaactcggaagggaacgaccatggacccctttgacaccgcgaccgtcctgacccgggtgctcacctccggggtggtgatgagcatcgagcgcagcgaccgggaactgccggcgctggagcggctgctcaccaaacgcaccgggcgggcccgcgcggtgctggtcaacagccgcaccgccgcggtccacgcggccctcgccgggcagggcatcgggcacggtgacgagatcacccagcccgggctgaaccggtccaccgcggccttcctctcctggctcggcatcacggtgcgacccggcgacccggcgaccttcgacgagatcgtcctgggcccgggcaacgccggtgagctggccgggctggcccggcacgccacggcacccgccctggtcgtcgacctcaccccgatcggcttcggcccggccgcggccgtgctcaccgacgacgagcagatctggacccgggccgagcggctgaagatcttcggcgcgttcgacctgcggaccatgtggacccaggaggaggcggctcccggcacggcgccgggagtccagttcaactaccggctcagcccgttggtggccgcctgcgtgcggatgtcactgaccagggccaccccgccggccgtcaccgcaggagcgcgagagtgatcaccgacttcccgtccgcccccctgaccctgcccgaccccgaggagctcacggccgagctcgcggccctcggcggcccggcgatcatcccgcccacggcccgccgcaccatcttcccggtgatcaccaaggaggacgtgttcaacctcctgctggcccagcgggccgacccgcagcaggtggtcgccgacttcgccgaggcgtaccggtcgtacgtcggggcgcggtacgccctgcccaccgcgagcggcacgtccagcctgcacctggccctgatcggggccggcgtgcagccgggcgacgaggtgatcgtgccggccttcaccttcatcgccaccgcgcaggccgtggtggccgcgcacgcggtgccggtcttcgtggacatcgacccgcgcacctactgtctggatccggccgccgccgaggccgcgatcaccggccgcacccgggcgatcatgccggtgcacgtccacggcctgccggccgacgtgccggcgctgcgggcgctggccgaccggcacgggctggcgctggtcgaggacgcctcgcacgcccactccgcgcggatcggggacgcggtcgccggctcgttcggcgacgcggccggccagagcctgatggcggacaagaacttcccgctcggcggcgagggcggaatcgccttcttcgactccgaggcgggctggcgccgggccgtcgactacgtggcccggcacggcatcgactaccggatgtcctgggtcgccgcggcgttcggcgcgagccagctcaagcggctgccctactacgacgagatccgggcccgcaactcccgggtactcgccgacgcgctcgacggtaccgggctgttcgcgccgccgttcgtgccgccgggtcacacccacgcgtacaacatgtaccggatcaccctgcacccggcggcggccgggctggacgacctgcccggatacgccgtcaaggaggccgtgcacgagctgctggtcgccgagggggtgccggcccgcgagtggcagaacacgccgatcccgtgccacctgccgttccagcgtcgcaccggcttcggcggcgggtatccgttcacgctgaatccggccgcggcccgcgaccaccggcccgaggacttcccggtcacgctcggcatgctggacagcaccctggtgctgtgccgggagctgcgttcgccggtcgagtacgagcggatcctgcggtacgccgacgccttccgcaaggtggcccggcgtccggacgcgatccgcaagctggtggccgaccgggactaccggcggccgtacgagaaggcggcccgccttggctgagcagcgcatccgggtcgccatcgcgggggccagcggctacaccggcggcgagctggcccggctgctgctggaccaccccgcggtcgagctggccttcctctcctcggagcggcacgccggcctgccggtggccgcgcagcacccggccctgcgcaaccaccccggggtggccggcctgaagttccggccgctcgacgagctgccggaaaccgacgtcgcgttcgcctgcctgcccaccggcgccctgccggcccggctgggtctgctggccgagcgcgcgaagcgggtgctgaacctggccggcgactatcggctggccgacccggcggagatccgcacccactatccggcgaccgccgagcacccggcgccggccccgttccgctacgtcgtccccgagctgaccgtgccgctgcccgactcccggttcgtcaatctgcccggctgcatggcggtggccagcgtgtacgccctctacccggcgctgcggcacgacctggtgcagcccggcgtggtggtcgacgcgaagaccggctcgaccggcggtggccggaactcgaccgagcagcatgccgaccgggccggcaacttccgggtccacaagctgcacgggcaccggcacggtccggagatccggcaggccctcgccgacctcgccgggtcggcgcccgacctgcagttctcggcgcacagcctggacgttccgcggggcatcctggtcaccgggtacgcccggctgcgctccggggtcacctcgctggaggtgaagcgggcgtacgcgcaggcgtacatcggcaagcctttcgtccgggtccgcccggcgcccaaggcaccgcaggacttccccatgctcaaggcggtggtcggctcgaacgtggccgaggtggccatcgcggtgcagggcgaccggctggtcgcggtggccgccctggacaacctgatcaagggagcgtccgggcaggcgatccaggtgatgaacctgcagcacggcctgcccgagacgaccggcctgccgttgacggcggccgccccgtgacccggccgctgtacgtcgtcaaggtcggcagcagcacgctggaccgggacggcatccacgacgaactcgacgagctggtcgcgcgcggggcccgggtgctgctggtcgccggcggcgcggccggcatcgagcggcactaccgggcgatcggccgggccgcgccgcagctgcgcctgcccaacggcgacgtggtccggcactgcccggccgaggagatgccgcacctggtcgacgcgtacgagaaggtcaccctcccggcggtggagggcggtctgcggcggcgcggccggaccgcgtacaccgcggtggcggcccgcggcggcctggtcaccggacgtccgaaccggccgctgaaggtggtgaccggtgcggggcgcaccggggtggtgcgtgaccaccgggtcggtgtgccggaccgggtggacgtcacccggatcggcgcgctgctggacgccttcgacgtggtctgcctgtccccgccggtgctcgacccggacgacgggctgccgctgaacgtcgacgccgacgtgctggcggccgcgctcgcccgcgccctgggcgccgaccacctgcgcctggtcaccggcaccgcggggctgctgaccgatccggccgagcccggctcgacgctgcgccacgcctacccgggcgaggccatggcgtacgccggtggccggatgcggcaaaaggtgcgcgccgccgagctcgccctggacagcggcgccgacgtggcggtcaccggtccgcacacgctgcgcgaggcgtccggctggacccggttctggccgacccgggaaccggccgccgacctggaactgctcacccacgcggtgagtgtgccctcggtctccggcgacgagcgggagctcgccggctacctgctggactggtgcgccgcgcggggcatcgacgcggcgatcgacgaggtgggcaacctggtcgcgaccaagggggacggggaccgcaccctgctgctgctcgggcacctggacacggtgccgcaccactggccggcgcgctgggccggcaccgagctcagcggccgcggctcggtcgacgccaagggcagcctggccgcgttcctggaggtgctgtccaccgtgacggtgccggccggcagccgggtgcgggtggtcggcgcggtcgaggaggagatctcctcgtcgaagggcgccttccacgtccgcgaccactatccggcgcaggccgtcgtggtcggggagccgagcggctcgcagaccctgacgctgggctacttcgggctgttcaagctcggggtgaccgcctcgacgccgagcggccactcggccgggatggacgccgtctcggctccggacgcgctggccgcggtgctgctgcggatccgggaggcggtcggcaagctggcgccggaggcgctgagcgcggtcatcgacctgcgcaccgagtcgcatccgggcgggcatcgcgcggccggcgtgctcaacttccgggtcccgccggacgccgacccggaggaactgcgcgaggccgccctggcggtccgcgggccggacgtcgaggtcgaggtgctgcgcaacacccccggttacgccgggaagcggtccgggccgctggtcaaggccttcaaccgggcgttcgccggggccggcgtccgcccgcggtacgtggtgaagaagggaacctccgacatgaacacgctcgccaccacctggcgggacgtgccgatggtggcgtacgggccgggtgactcggcgctcgaccacaccgacgtggagcgcatcggcgctgacgagtaccgggccggccgtgcgatcctgaccgcggccgtcgagcagtggctgaccctgggcggcgaccggtgaccgctccggagatcctggccggtcaggcacgcgaggcgcgccggctgatcgtcgacatggcggccagtgagcggggctgccatctgggcggcagtctgtcggtcaccgacatcctgatcgccgccctggaccgggccctggaagccgacgacggcacccgggtggtgctcagcaagggccacgccgccgccgggctctatgccgcgctgcacgtcaccggcgtgctcaaggacaacccggccccggtgtacggcctggccgggcacccgttcaccggccatcccggcccgaaggtgcccggcgtggtgttccccaccggcagcctcgggcacggcgtgccgtacgcggcgggctgggcgctggcccggcggctgcgcggcgaacccggcctggccatcgcggtcaccggcgacggcgagctgcaggagggcctggtgtgggaggccgcccaggtcgccgcggcccgccggctgggcaatctggtgatcgtggtggaccgcaacggcggtcagaacgacggcctggtcgcggacatctcgccgctgcccggcctggccgaccggttccgcgcgttcggcttcgagacggccgaggtggacgggcacgacgtggccgcgctgtccgcggtcctggcacccggccgggacggcctggaccggccgctggcggtgatcgccgacaccgtcaagggcaagggcgtgccgccggtcgagggccgggcgaactcgcactacgtgaccatcgacgccgcccgggcggccaagtggaaggcactggtccgatgaccctcagcgggcgtgacgcctaccgcgacgagctgacccggctcgccggcagcgacgggtcgatcctctgtctggaggccgacctcggcggcaagggacatccgttccagaaggcccacccggaccggttcttcaacctcgggatcgccgaggcgaccatggtggacatggccgccgggctggcggtcgccggcttccggccgttcgtcagcacgttcgcgccgttcgcggcgctgcgcgcggcggagagcctcaagctcaccctcggctacctgggcgcgggtgtcaccgtggtggcgccgtacgccggcgtctccggcgcctggttcggcaccacccaccactgcctcgaagacctggccgtgctgcgcagcatccccggggtcaccatcgccgccccctacggcgagcaggagatgcgggcggtgatccgggccgcggcccgctccgggcggccgcactacatccggacgggacgcggcgcggcgtacgacagcctgcccttcgacggcgacgaccgcccgccggtgcagtggcagaccggcccggacccggcgaaggtctgcctggtctcggtcggcgaggagggcacccggctcagcctggaggcccgcgcggcgcggccggccgccgaccacgcccacctctgctacctcgaccacgagggcctgcgtgcggccgcggccgagctcgcccgccggcacagccggttcgtggtggtcgaggagcaccgggccgagggcggcatcgccgaggccctcgccctgctgctgcccggccgcacggtgaccggcgtcaacgccggccacggctggccctccgagggcggcgaccaccaccaggtgatgggcgggctcggcctggatctgccggccgtcctcgccgcactcgacgaccacctttccgacggagtgtgagacgtgtccgaactgcacatcgacttccggggcgagaccccgaccccggcacccaacgcgcccggggcgcgcccgggcgggcggctcatcctgctcgccgacgccgagccggaacacatggatccggcgcagacctacatcggcaccacgctggcggtcgccacggcgctgttccaccgcaccttgaccggctacctggaggacccggcgggtggcccgcggcggctggtcggtgacctcgccaccgacgccgggcgcaccgatgacggcggccggacctggacgtacacgctgcgcgagggactgaagtacgccgacggccggccgatccgggcacaggacgtcgcgtacgcggtggcccgctcgttctcgccgtacggcgtgtacggcccgcagttcctgcagcaggccctggccccggacggcggctacgacggcccgtacgcggacggcgcgccggcgcccggcgtcgagactccggacgaccggaccatcgtgttccgcctgcccgccccggaaccgctgttcccgctgctggccaccaccacgaccaccacgccggtgccggccgaccgggacacccgggagcggtacgagaccgactgggtcgccaccggcccgtaccgggtgcgcgagttcgtgccgggcagccactacctgttcgagcgcaacccgcactgggacccggccaccgacccgatccgcagccggaacgccgacgagatccgctgggagttcggcgtggaccgcgacgagcagacccgccggctgcttcacccggccggcgacgacgtgcgggcgatcgccaccttcgacgtcgcccaggaccgggtcgacgaggtgctcggcgatccggagctgagccgccgggtggtcgccggaccgtcggtctacctgcagtacatctacatcaacacccggcgggtcaccgacgtcgacgtgcgccgggcgctgaacttcgcgatcgaccgcgagacgctggtcgcgctggccggcggcccggccgcggcggagccggcgaccacggtgctggcgccgaacatccccggctaccggccgtacgacgcgtatccggccggggcttccggtgacccgctgcgggccaaggagctgctggccggcaaacagctgcggccgctggtgttcgcctacccggacaccctgcccaacgtgccggtcgccccggcggtcaaggccgccctggaacgggccgggttcgagatcgtcccgcgggcggtcgacaaggccgccttctacagcctgatgggcgacgcggagaacgactgcgacctgatctacggcgtgtggggtccggacttcccggacgcgtccggcgtcttcgacgtgctgttccgcggcgaccggctgaccgccgccgggaacatgaacctgtcctacttcgacgatccggagatcaccgcccggctggccgtgctcagccgggagccggaccggggcgcgctcgccgacgcgtacgccgagctggaccgcgacctgatggcccggcacgccccggtggtgccggtctactacaagcgccagctgactctgtacggcccggccgtgggcgggttgtcgctcagcgcccagtacttcgtgcccaacctcacccgcgcgtacgtcgccggctgaccctcgcggaaaggatcaccacccgcatggacacctcgcccggcgccggccgcctccggtcggcggtcagcgcccgcttcggcggccttccgcgatcgttctggatcgtcttctccggaatgatcgccaaccggatcggcaccatggtcgtgccgttcctggtcttcttcctgggcgcccgcgggttctccaccgagctgaccggcaccatcgtcatcgtgctcggcttcggcgggatgttcgggccggcactcggcggcctgctcgccgaccggatcgggccgcgcctgacggtgatcgtcggcctggcgctgaccccgttcagcctgggcgcgctgtacggcgcgcccaacctggtcaccctggcgatcgcggccggtctgctcgggctgaccggcaccatctaccggccggcgtcgtcggccctggtcgccgagacggtcggcccggacgggcgggtcaaggcgttcagcctgctgcactggggcttcaacatcggcaccgcggtcgccaccgggatggccggcttcctcgcggtccgcggctactggctgctgttcctggtcgacgggctgacctgcctggtgtacgcggtgatcgtgctcgtcggcatcccgccggaccggcgtgccccggcggccgagcgggtgcacggcatcgggtacggcgtcgtgttctccgaccgtctgatggtcggctacctggtgctcagcgcggtcggcatcaccgtgtacacgcagaccgagttcaccctgccgctggccatccggctggacggtctctcgccctcggtctacggcgcggtcggcgccctgaacgcggtactggtcgtgctgctgcagccgctgctgttcggctggctgtccaaggtcgaccggatccgggtgctcgccgcgtcctgggtgctgatcggtgccggcgtcgccggcaccggcctggccgaccacctctggcagtacgcgatcaccgtggtcgtctggtcgatcggcgaggtggtcaacggcatcgtggccggctcgatcgtcgccgatctcgccccgcccggcgcacgcggccgctaccagggcgcgttcacctgggtctgggcgctcgcccggctggccgcgccggcgaccgcggtcggcctgttcggcacggtcggcccggccgtcctctggtggggctgcgcggtcggcggcctcctggccggcgtcgcctcgatcgccctcggcccggccttcgcccgccgcttcgccggcaatctcgagtccaccccgaaacaggaggcaaccgcatgaccgaccagcgcaccgaggcgtacaacgccctcgcccgggacgacttcagcccgctgcggcgggtcatggacgacgtcgagaaacacccgtcgctgagcaactggaccggctcctacctgccgcggccgctgttcgccgaccgccggcagctggacgccttcgccgccgacgtgctgaccctcttcgacgtgatcacctcgctgccggaccggctgttcgacggcgacctggaccggtacaccgcggcgctcggtgtcgagccgcgccgggcgaagctgatccgctcgctcggcgggatcaccccgccccggtacggccgggccgacatgtaccacgacggcacctcgttcaagctgctggagatcggcatcgccagcgaggtgggcggcgccgaccgggccggggagatcccgcgtgccctgctggagaacgaggcgttcgccgggttcgccgccgagcacggcctggactacgtgcacaccggtgagcgggtggcccgcaccctgcgcgccgccggagcctcgatcggcgcggccgagccggtggtcgtcctgctggaggcgcccggcgggctggcgaactacgcgagccactggaacaccttccgggacgtgcagcggcgtgccggcctcgacttccacgtcgcggagatcggcgacatcaccgaccgggacgggaaactgcacctcggcgacgtcgcggtcgacgtgatcctgcgctgcttcacggtcgaggagctgatcgccgagccggacggtgaggcgctggtcgagccgatcctgcgggcccaccgggcgggcagcgtggtgctgttcaccccgctggagagcaacctgttcgccaacaagggcgcgctcgcgctgctgtccgacccccgccggcgggccgctttcaccgccgccgagcaggccgtgatcgaccgggtgctgccctggacccggtcgctcaccgacgccgacgaactcggcctgatcgacctcggccgggagcgccgggagacgctgatcctcaagccgaacggctactacggcggggtcggcgtgatcgccggctgggagaccccggaagccgactgggagcgggcgctgcgcgagggcgtcgccgacggcgcgatcatccaggagcgggtggtaccgcgctccgagccggtggtcgacccgggcaccggcgaggtccagccgtggcaggcggcctgggggctgttctacaccccggagggcttcgccggggcgtacgggcgggcggtgccggccttcgagagcgcggtgatcggtgtgaccgcgtacaagaacacccgtaccgccggcgttttccactactgagaatcactgaggggatggtcgtggcaggaaatctgtcccggatcgaggccgaggaacgcggccgcctgctccaggtgctgtcgtacgccgtcgagctggacctgaccggcgacgcgacgtcgttcggcaccaccacggtggtgcggttcggctgcacccggccgggcgccacgaccttcgtcgacctggccgtgcccgggctgcggcgcgccgtgctgaacggcgtgccgctgcccgcgacggcctacgacgccgaccgggggcggatcacgctgccggacctgccggcggacaacgagctgcggatcgaggcggtcggcgcctattcccgtaccggggaggggctgcaccgcttcaccgacccggtcgacgacggcgtgtacctgtacacccagctcgccccggcagacgcgcaccgggtgttcgcctgcttcgaccagccggacctgaaagccccggtcacgctgaccgtgctggccccggccggctggcaggtggccggcaacaccgcgggcacggcgtcgccggccggcggggacaccgcgcggtgggagttcccgccgaccccgccactgccgacctacgcggtcgcggtcgtcgccggcgactaccacgtcgtcgccgacgagtacccgtcgatcccgctgcggctctggtgccgccgatcgctggccggcagcctggacgccgccgagctgttcgcgatcaccaaggccgggttcggcttcttccgggacgcgttcgaggtgccctacccgttcggcaagtacgaccaggtgttcgtccccgacttcaacctgggcgcgatggagaacgccggctgcgtcacggtccatgagaagtacgtgttccggtcccgggtgaccggcctgatgtacgagcgccgcgccgagacgctgctgcacgagatggcccacatgtggttcggcgacctggtcaccatggcctggtgggacgacctgtggctgaacgagtcgttcgccaccttcgccggggtgctggccctggtcgaggcgacccgctggaccgacggctggaccacgttcgcgaacctgcgcaaggccgaggcgtaccggcaggaccagctgccgtcgacccacccggtggccgccgacatcgcggacatccgggccatcgaggtcagcttcgacgcgatcacctacctcaagggcgcgtcggtgctcaagcaactggtcgcgtacgtgggccaggaggagttcctggccggcgtccgcacctacttccgggcgcacgcctggggcaacaccaccctgcccgacctgctgcaggccctggagaagtcgtccggccgcgacctgcggccgtgggccgagcagtggctggagaaccccggcgtgaacgtgctgcgcccggtcgccacggtcgacgccgccggccgctacaccgcgttcgccgtacggcaggaacgcgggccgcgctgcccggtgctgcgctcgcaccggctcgccatcggcctctaccggctcggcccgggcggcctggtccgcaccgaccggctggagctggacgtcgccggcgagctcaccgagatcaccgagctgaccggcgccgaacagcccgatctgttgctgatcaacgacgacgacctgacgtacgcgaagattcggttcgacgaccgctcgctggccaccgtgctgacccggatcaccgagctgaccgatccgctggcccgcgcgctgtgctgggccgcgctctgggacctggtccgcgacggcgaactgccggccgaccggttcgcgtacacggtggccgccgccctgcccgtgctgatcgacggcacgctgctgcagaccctgctcgaccaggcgcgcacggcactgcaccgcttcgtcgccccggcccgtcgcgccgagctcttggcccggctggccgaggcgaccgccgccgagctcaccgccgccgagcccggctccgaccgccagctggtcctcgcccagcagttcgcggccaccgccgtcaccggcgctcaactggacctcctcgaggatctgcgggccggcgtacgcgttccgcagggcctggtcctcgaccccgacctgcgctgggcgctgctgcgccgcctcgtcgtgcacggccgggccggcgacccggagatcgacgcggagctggcttgcgaacccaccgcggtcaccgcccgcagcgccgccacctgccgggccgcccgccccaccccgcaggccaaagccgcggcctggtacgcgctgaccggcggcgagctgaccaacctggaactgcgggccgtcctggagggtttcgccgagccggagcatgctgcgctcctggaaccctatgccgcacaatatttccagcagatcgatcgggtatggagggaatggtcgagcgggatggcgcagcgtttcgtgaccggtgcctaccccgcctggtcggtcaccccggacacgatcgcccgcaccgacgcccacctggcccgcccggacgtccccgccgcgcaggcccgcctgctgcgcgaggcgcgcgacgagatcgtccgcgcccgccggctgctcgacctcgaagattggacggaaactccccgatgaccacccgagcgttcctcttcctgctggccagcgcccgcccggacggcaacacggagctgctggcccgccacgccgccgccgagctgccccccggcgccacccagcgttggatccgcctcgccgacaccccgctcgacacctacgcggacatccgccaccgggaacccccgcaggagcgcatccccaccggcgccgagcgcctgctgctggacgccaccctggaggccaccgacatcgtcatcgcctctccgctctactggtacagcctgtccgccgccgccaagctctacctggactactggtccggctggctccgggtcggcgcccccggctccttccgcgcccggatgaccgagaagaccctgtggggaatctccgtctacagcggcgacaaccccgcggacgccgatccgctgctcggcgccctccagaaatccgcggaatacttccccatgcgctggggcggcctcctcctcggccagggcaaccgccccgccgacatcctccaggacacccccaccctgacccgagccaagaccttcttcagctgaccggtaagcagtgccccctcggtgaccggggccgtcacgacggccccggtcacccacgtcgtaccgcctatgggctatgagcctgaccggcagcatccgcacctctcacccgggaaagcgcgatctgcaccggcgccctgtgcccgcagcgacccgcaaccgagctcacgaaggttcccagagcgacccgatgggcgccgaggcatcgcggtgcggggtccggggctcgtgcccacatgctgaaaccggtccccgtgcccgcagcgaccaacaaccgagcttgcgaagggtccccccgagcggcccgatggggctccggggtgtccccggcgcggggtctggggctcgtgccccaggctggaaagcacgatgggcaccgctccgcgcttctcagcggacgcaggtgcccaatcccatcgtgcccccggcaggattcgaacctgcgctttcgcctccggagggcgacgctctatcccctgagctacgggggcccagtgattcagaagcctagcaggctccggggaaccaccgccaaccggtaccggtgtcgccgttttcagctgttctgggcctgcttgagcaggtcgtcgatcagctggatctcgccctgctgggctttgaccatgctgtcggccagccagtcgacgtctttgttcgaggagagtcgttccgcttcctgggccatgtggatgccaccgaggtggtgggcgcgcatcagggtgaggaattggatgtcgagctgcttgccggtggctttgcggagcgcggcgagttggtcgggggtggccatgccgggcatcaggccgttgacgacggagccggcggagtcgggcatccaggccatggcgggtctgtcgccggtggggtcgaggtgccagtcgcggagccaggcctgcatgtagccgatctgggcctgctgggtggtggcgatgtcggtggacagggtggcgatgcccggggtgtccgagccggcgtgggcgatcatcgccatttcgacggcctgggcgtggtgggtggacatgtcgcggaagaagccggcttcgacggagtcggtgccgggagtgcggaactgggggatgacgaggccgatggcgacgccgaggacgatgccggcgagcagcagggcgagggcggcgtagccgaagcggcggccggccggggcggggccctccccggccgccgtcgcggcgtccggggaggtcacgtcggggatcatgagcttgcggtgggcgccgggttcatggtgctgccgttgctgccggcggtcaccgggccggtggtggtgttgccgctggagcagggggcgccgggctccatggaggccttgatccggccggcggcgacgaagtcgtcgatccgcttgtccttcacgtcgtcggtcttgaactggtagccccagacctggaccgagacgttcttgtcgaggccggtgtagggcgacatgaacatgtagtccttgccctcgaccttcttctgcaggaccgcgacctggtcggcgggcaggccctgcttgtaggtgatccagaccgcgccgtgctcgaggctgtgcaccgcgtgctcgttggcgatcggcgcgttgtagacgtcgcccatgcagttctgccaggcctggttgtgcgcgccgccgaccggcgggctggtcaggtaggtgagcgcgccgtccttgtgggtgcggtcgtcgagctgcgggttcttctgcgcgcggtagttgacgacgccggagatgtcggccatcttctcggtccagtcgcgggtgctctggaacgaggcgtacacgccgtagccgatgatgccgatcgcgacgagggcgacggccgtgccgacggcgatcgggccccagttgcggcctccgctcaccttgaccggggtgaccgctttgcggcccttgccgccctttccgcccttgccggcgggaggccggtttccggccggcttgccggtgggcggtttgccctgaccggtggtcttgccgaccttgacggtggacgggacccgttcgggacccggcgtgctcatgctcatcgtgcctcgtcgattcgtcaaataaggggaagggcggccgccgaacgctgaagtctacccccgatagcatggcccagtgactcccgccaaccttgctgacactgttctctcagctgctcgtgccgttttcgagacgcgtgggctggatccggccgcgctgcccgccaccacgtcgctggagcggccccgcaatcccgagcacggcgactacgcctcgacgctcgccctgcagctgggcaagaaggtcggcgtggctccgcgcgagctggccgccgcgctggcggcggagctgggctcgcgggccgggatcaagtcggtggagatcgccggcccgggcttcctgaacatccggctggacgccgcggtcaccggcacgatcgcccgcaccgtggtcgaggccggcccggcctacgggcggaacacccagctcgccggtcagcggatcaacctggagttcgtctcggcgaatccgaccgggccgatccacctggggcacacccgctgggccgcggtcggtgactcgctgcgtcgcatcctggcggccgccggcgccgaggtgaccagtgagtactacatcaacgacgcgggcgcccaggtggaccggttcgcccggtcgctgttcgccgccgcgaacgggcagccgaccccggaggacgggtacgtcggcgactacatcaccgagatcgcccagcgcatcaccggtgccgacccggcgctggtgggccggccggccgaggcggtgctgccggtcttcctggagcgcggctacgagctgatgctcgccgagatccgggcgagcctggagcgtttcggcgtgcacttcgacgtgtggttctcggagaagagcctgcacgacggcggcgcggtcgagcacgccatcgcggagctgcgcaagcaggggcacatcttcgaggagggtggcgcgatctggctgcgcaccaccgacttcaccgacgacaaggaccgcgtgctgatccggtcgaacggggagaagacgtacttcgcggccgacgcggcgtattacatcaacaagcgggagcgcggcttcgaccgttgcgtctacctgctcggcgccgaccaccacggctacatcggccggctcaaggcgatcgccgcgtgtgccggcgacgacccggacgacaacatcgagatcctgatcggccagctggtcaacctggtccgggccggccagccggtccggctgtcgaagcgggccggcaacatcatcaccctggacgagctgctcgaggcggtcggtgcggacgccgcccgctactcactggcccggtcgtccaccgactcgatgctgaccctggacatcgaggagatcaccaagcactcgaacgacaacccggtgcactacgtgcagtacgcgcacgcccggatctgttcgatcctgcgcaacgccgacgagcggggcatgagcaagggcgaggggtacgacccggccctgctgtcgcacgagcgggagaacaacctgctcaagacgctcggccagttccccgccgtggtggccaccgccgccgagctgcgcgagccgcaccggatcgcgatctacctggaggagcgggtggccaccgacttccaccggttcttcgacgcctgccaggtggtgccgaagggtgaggccccggtcgaggacgtgaacgtggcgcgtcgctggctggccgaggccacccgaacggtgatcgcgaacggtttggccctgctcggcgtgtccgccccggagaggatgtagggcatgcgcgcacacgaggccggggcgctgcacggcgacctcggcaaccgcgggccggcctggttgcggacgcccgaggacgtgaacgccctcgtgccgcagctctggccgcgcacggtgacccgcaccgacgccgggtccctgcagatcggcggcgtcagcgtgaccgacctggcggccgactacggcaccccggcgtacctgctggacgaggacgacctgcgggcccgctgccgggacttcgcggccgccttcgccggcgcggacgtctattacgccggcaagtcgttcctgtgcaaggccgtggtccgggtggtcgaggaggagggcctgttcctcgacgtgtgttccggcggtgagctggcggtggccctggcggccggcttcccgccggagcggatcgggttccacggcaacaacaagtcggccgccgaactggcccgggcgctcgacgcgggcgtcggccggatcgtggtggactcgttccacgagatccggcgtctgaccgaactgtcccgcgagaccggtaaacgccccgccgtgctggtccgggtgacggtcggggtcgaggcgcacacccacgagttcatcgcgaccgcgcacgaggaccagaagttcgggttctcgctggccggcggcgcggcgttcgcggcctgcgcgcagatcctcgacgagaacgtgctggacctgcgcggcctgcactcgcacatcggttcgcagatcttcgacaccagcggattcgaggtggccgcccggcggatcctggaactgcaggcgcaggtgcgcgacgcgcgcggggtggagctgcccgagctggacctcggtggcgggttcggcatcgcgtacaccacgcaggacgatccgtcggcgccgggcgacctggccaagcggatcaacaagatcgtcgagtcggagtgcgagatggccgcgctgcgggtgccgcacctgtcgatcgagccgggccgggcgatcgtcgggccggccgtcctcaccctctacgaggtgggcacggtcaaggacgtggacggcatccggacgtacgtcagcgtcgacggggggatgagcgacaacatccgcaccgcgctgtacgacgcctcgtactcggccaccctggcgaaccgccgctcggacgccgaacccctactggcccgagttgtgggaaaacattgtgagtccggagacatcgtcgtgaaggatgaattcctgcccgccgacgtgcagcccggagatcttgtcgccgttccgggaaccggtgcctactgccggagtatggccagcaactacaaccacgttcctcggccgcccgtggtcgcggtgcgcgacggcgcggcccgcgtgatcgtgcggcgcgagaccgaggacgacctgcttgcattggatgttggatgagccaggggaaaccggtacgcctcgccctgctgggctgcggcaccgttggtactgaagtaatccgtctgttgcacgagcaggccgacgatctgaccgcccggatcggggccccgctggaggtcgccgggatcgccgtgcgccggctcggccgcgaacgcggcgacctgccggtcgatccggacctgttcacctcggacgcgctgggcctgatcaagcgcgacgacgtcgacgtggtgatcgaggtggtgggcggcatcgagccggcccgcacctggctggtcgaggcgctgcgcgcgggtaagagcgtggtgaccgcgaacaaggcgctgctggccgaggacggcggcacgctgcacgacgcggccgccgagggcaacgccgacctgtactacgaggccgcggtggccggggcgatcccgctgctgcgcccgctgcgcgagtcgctgcacggcgaccgggtgaccgcggtgaccggcatcgtgaacggcaccaccaacttcatcctctcctcgatgttcagcaccggcgccgggttccacgaggcgctggaggaggccaccgagctcgggtacgcggaggccgacccgaccgccgacgtggagggcttcgacgccgccgcgaaggccgcgatcctggcctcgctggccttccacacccgggtcaccgccgcggacgtgttccgtgaggggatgaccgcggtgacggccggcgacatggccagcgccaaggagatgggctgcacgatcaagctgctgtgcatcgcgcagcgcagcgccgacgcggtcagtgtccgggtgcacccggcgatgatcccgctcagccatccgctggccggggtcggcgacgcgtacaacgcggtgttcgtcgaggccgacggcgcgggcccgctgatgttctacggccggggcgcgggtggccggccgacggccagcgcggtgctcggcgacatcgtcgcggcggcccgcaacaagctgaccggcacccgggcgccgagcgagagcaactacgcccagctggcggtccgcccgatcggcgagtcgatgacccgctaccacatcagcctggacgtggccgagcgcccgggtgtgctggccaccgtggccggcgtcttcgcccagcacgaggtgtcgatcgccacggtccggcagtccggccgggcggacgacgccaagctggtgatcgtcacgcacagcgcgccggacgcggcgctggccgccaccgtcgcggcgctggccgagctggacatcgtccggtccatcgcgagtgtgctgcgggtcgagggtggggcgggctgatgctcgatcacgtcggtttccagtgtgccgacctggccgccagcgccgcgttctacgacgcggtgctggccccgctgggcgcttcccggcagatggatttccaggtggccatcgggtacggcaacggacaccccgatttctggatcagcaccctgaccgagggggacgggttccgcgagtcgcacatagcctttggtgcggcggaccgggcggccgtggacgcgttcttcgccgcggcggtcgcgtccggggccgaggtgttgcacgagccgcgcctgcacccggagtaccacgagcactactacggcgcgttcgtccgcgacccggacggcaacaatgtcgaagcggtctgtcaccgtcctgaatagtggacttccggtcccattgatcggatgtctagggcacgctgtgcgcgattgcccgactcgacaacgaggagttacggccatgtggcggggtttgatcgaggcgtaccgggagcggctcccggtgaccgaggccaccccggtggtcaccttgcacgagggcaacacgccgctggtgccggcgccggtgctctcccagcgggtcggtgcggacgtctacctgaaggtggagggcgccaacccgaccggttcgttcaaggaccgcgggatgaccatggcggtctccaaggcggtcgaggacggcgccaagaccatcatctgcgcgtccaccggcaacacctcggcgtcggccgcggcgtacgcggcccgggccgggatcagctgcgcggtgctggttccccagggcaagatcgcgctcggcaagctgtcccaggccctggtgcacggggccaagctgctgcagatcgagggcaacttcgacgactgcctggcgctggcctcgaaactctcccaggacttcccggtcgcgctggtcaactcggtgaacatcttccgcctgcacgggcagaagaccgcgtccttcgagatcgtcgaggcgctcggggacgccccggacatccactgcctgccggtcggcaacgccggcaacatctccgcctactggatgggttatcaggaggacaaggaggccggcaacagcacgaagctgccgaagatgtacggcttccaggcctccggcgccgcgccgatcgtcaccggcaaggtggtcgagcagccctccacgatcgccaccgcgatccggatcggcaatccggccagctggaccaaggcgctcgacgcccgggactcctcaggcggcctgatcgcggcggtcaccgaccgggacatcctgaacgcgtaccggctgctggctcgtgaggtcggcgtcttcgtcgagctgggcagcgcggcgagcgtggccgggctgctgcagcaggcggcggccgggcagatcccggccggctcgcgggtggtctgcacggtcaccggtcacggtctgaaggacccggagtgggcgatctccacggcgccgtcgccgatcgtcgtcccgaacgaggcgctggccgccgcgaaggcgctagacctggcctgacgccgcctcgcgcaccagaatctcggtggcgtgaagcaccaccgcgagctcctcggctgagagtcggctgaggagctcgcgctgtttcgtcatgcccgcggtgatgatgccctcgatgagctcagcgcccgctttcgtgaggccgatccggcggatccggcggtcgttgagatcctccgtgcgcgtgaccagatcctgcaccacgagccggtcgatcatgccgctcagtgcggcggccccgacgcccaccatccgggccagctccccgccgggcaacgtcccgtgccgggagagcagcaggagtattttcagctgggacatcgtcaggtgtgacgagaagagtgggtgcgaccggtcgtcggcgaacaggtgctgcaaccggatctgcgcgcccatgatgtccgcgatgagcttctcgttcgcgctcagcgcccgctcctttgtgacctgctggtgaccaccgcacatcgatctgatgacggacggtaccagtgcacccccgcgaaaaatcatttgttcgcgtggggcaaactatttgtgtcggacgaagtttactcgggggagcgcccatgtcagctctgacacggctcagccttgccaaccgaggtctcgtcgccctgatcgcgatagtgatcagcggcttcggcctctatgcgattccgtcactcaagcaacagctgttcccgtcgatcgagctgcccgccgcgttcgtcagcgcggtgctgcccggcgcctcgcccgaggcggtcgagacggagatcaccaaaccgatcgaggacgccgtcaagggcatcgacgggatcgacacggtcacctccacctcgcgggagaacgtgtccagcgtcgtggtctccttcgcctacggcacggacatccagtccgcggtcaaccaggtcaccacctcgatcaaccggatccagtcgcagctgccggacaacgtcgacccgcagatcttcgcgggcggcaccgacgacatcccggccatcgtgctggccgcctccggcggcaccgacgagagcgacctgttcaacaagctcaaccagatcgtggtcccggagctgaacgggatcaccggcgtccgggacacccaggtcaccggcgcccgcagcaagcaggtcgtgatcacgccggacctggccaggatgggcgcgaacgggatcgcgccgaccgcgctcacctcggtgctgcaggccaacggcatctcgatcccggccggtgcggtcaccgacggcaccaggtcgttgaccgtgcaggtcggcaccccgatcaccacggtccagcagctgcaggacgtctacctgaccggctcgcgcggcccggtgcgcctcggcgacgtcgccaaggtggagagcaggctcccggtcgccgactcgtacacccgcaccgacggcgcggacagcctgggcatcgcggtcaccgcgcggcccgacggcaacccggtggagatctcccaccaggttcgcgacatgctggacaggctgcagaaggactccggcgccaagctcaccgtgatcaccgaccaggcgccgtacgtgcagcggtcgatcaagagcctggccaccgagggcctgctcggcctcgccatggccgtcgtggtcatcctggtcttcctgctcagcgtccgatcgacgctggtcaccgcggtctccatcccgctgtccgtgctgatcgccctgatcgccctctggaccggcgactacacgctgaacctgttgaccctgggcgcgctgacgatcgcggtgggccgggtggtcgacgactcgatcgtcgtcctggagaacatcaaacgacacctggagtacggcgaggagaaggtgcacgccatcctcgccgcggtccgcgaggtgtccggcgcggtcaccgcctccaccctcaccacggtcgccgtcttcgccccgatcgcgctggtcggcggcctggtcggacagatcttcgcgtccttcgcgatcaccgtgacggtggccctgctggcctcgctgttcgtcgcgctgaccgtggtgccggtgctggcgtactggttcctcaagccgccggccgccgacgtcgacaccgaggcgatccgccgggccgccgaggagaaggagctgcgcagcccgctgcagcgcggctacctcccggtgatccggttcgccaccacccgccgctgggccaccgtgctgatcggcatcgcggtgctgatcggcaccttcgcgctctccacccggctggagaccaacttcctggaccagtccggccaggacagcatcagcgtcacccagacgatgccggtcggcaccagcctggcggccaccgacgaggcggccaagaaggtcgaggcgatcgtctccggccgcaaggacgtcaagacgtaccaggtcaccgtcggcggcaactcggcgaacccgttcgccggcggcggcggtgccggcaccgccacgttccaggtcggtctgaccgatgacgcggacgccgacgtggtctccgaccagctgcgcgacgagttcgccaagctgtccggcgccggcgagatcaaggtcggcgagcagagctcggggctgggcagcaaccagctctcggtcgaggtgaccgccgctgacaacgacacgctgaccagcgcgacggagcaggtcaaggccgcgatggccgggatcggcggggtcgccgacgtggacacctcgctggccgccagcgtgccccggctggacgtggtggtgaaccgcaaggcggccgccgcggccgggctcaccgaggcgcagatcggccagaccgtggccggcatgttccgctccgccccggccggcaagctcaccatcgacggcgccagccaggacgtggtgatctcgttcggcgccgcaccggggaacccggacgcgctcaggtcgctgccgctgaccaccgcccgcggcccggtgccgctcagccaggtggccgagatcaagcaggtcaacggcccggagcaggtgacccgcacggacggcaaccggaccgccacggtcaccggcaccgtcaccggctcgaacctgagcaaggtgaaccaggacctgacgaagaagctggacgcgctgaccctgccgcccggcgcgtcgtactcggtgggtggcgtcagcgccgaccaggcggacgcgttcaaacagctcggactggccgtgctggccgccatcgcgatcgtcttcatcatcatggtggcgacgttccgcagcatcgtgcagccgatcatcctgctggtctccatcccgttcgcggcgaccggcgcgatcggcctgctgctggccaccggcaccccgctcggcgtgccggccctgatcggcgtgctgatgctggtcggcatcgtggtcaccaacgcgatcgtgctgatggacctgatcaaccactaccgcgcggccggcatgggcgtgcaggaggcggtgatcgagggcggccggcaccggctgcggccgatcctgatgaccgcgatcgcgaccatcttcgcgctcatcccgatggcgctcggcctgaccggcgagggcggcttcatctcgcagccgctggcgatcgtggtgatcggtggtctggtcagctcgacgctgctcaccctggtgctggtcccggcgctctacacgatggtggagaaccgcaaggagaagcggcgggccaagcgcgcggcgaagcgggcccgcaaggccggggtcgtcccggtgccggccgacgagccggtcgcggacgacgcggcgccggcgatggagcccgccgccagcggggcgctgcgggggtacaccgaccagttcgaggtgctcaagatgccgaagggcccggccgagacgcaggagtagcccggacccgacgtaccggaaaaaaataagcaagaaataaggtagtcgatgcccggcccaccggccgggcatcgcttccgctcccggtccgactagattgcggtacgtgtcggcaaccctctcggtccttaccagaaatcgtgacttccggcgtcttttcgccgctgagctggtcgtcttcggtgccgactggttcgtcatggttccgctgctggtgctgctgccgcggctcaccgggcacggcttctggggcggtctggtgctggccgccgacaccgggatcaacgcgctgctgctgccctacaccgggacggtcgccgaccggcgggaccggcgccggatcctgatcgccgcgaacctcgcctcgttcctcgccgtgctgctgctgttcgcggtccggtcggccgcgaccgcgccgctggccctggtcgcgatcggggcgatggccgtggccaaggccttctaccagccggccagctcggccgcgctgccgaacgtggtggatccggccgacctgccggccgcgaacgcgatcgccgggtcggcctggggcacgatgacggtgctcggcgcctcgctcggcggcgtggtggccagcgtcttcgggccgtacgccagtttttcggtgaccgcggtcggtctgctggccgcgagcctgctcaccgccctggtccggcgtccgctgcaggccggcccggccgccgcggaggcgtcgccggcgagcgggccggcgctgcgcgaggcactgcgccacatcgccgtccggccccggctgcgggcgctggtcacggtgaagtcggcggtcggcctgggcaacggggtgctgaccgtgttcccgttgatcgtggccgcgcacggcgccggcgagctgggcgccggcctgctcttcgcggtccgcgggctgggcgcgctggtcgggccgttcgtgatgcgcccggtgctggcccggccggcctggctgttcaccggcctggccctgtccatgggcctgtacggcctcggctacctgggggtcgccgtgaccccgtggttcccgctggtgctgctgctggtcttcgtcgcacacttcgccggcggcgccaactgggtgctctccaacgtcgccctgcaggccgaggtgccggacgggctgcgcggccgggtcttcgccaccgacctgatgctcgcgacgctggctatcgcggtcagccagctgggtgccagcgcggtcgtcgaccgggtcgaccaggcggtggtgatcgccggctgtggcctggtcacgctggtttacgcgatcggctggtggctggccacccggcggctggcggcggattccggggccgggaatgggattgccggggcacggcatccgtcctgagatgatcaagtcatagcatgtggcgatgggcctgaccttcgtcaccgaaccggtatccgtcagcaccccggcgaccagtgcgaacctgggcccgggcttcgacgcgctgggcctcgcgctgagcctgcacgacgacctgaccgcccgggtgaccgagggcggcttccacgtcgagatcagcgggcagggcgccggtgagctgccggccgacgaggagcacctggtcgtgcgggccatgctggccaccttcgacgagctcggtgagcgtccgccgggactcgcggtcacctgcgtcaaccggatcccgcaggcgcgcggcctgggcagctcctcggcggccatcgtgggtggcgtgcagctggcccgcggcctggtcgccggcggcctggagctgatcgacgaggcggccgcgctgcgcatcgcggcgcgcatcgagggccacccggacaacgtcgccccctgcctgctcggcggcttcacggtggcctggaccgaggccggtggcgcccgcgcggtcaccttgacgccggccgagggcgtgcgcccgacggttttcatccccgccgaacgggggtacacggcgaccgcgcgggcggcgctgccggccgaggtgccgcatcgggacgcggcgttcaacgccgggcggtccgcgctgctcacccacgccctgacgagtgatccgtcgctgctgttcccggccaccgaggaccggctgcaccagggatatcgcgccgcgggaatgccgggcacgtcgtcgctggtggcggcgctgcgttcggtgggcgtggccgccgtggtcagtggcgccgggccgaccgttctggcattgaccgaggtcccgggtgatttttacccgggcgcgcactggcacggcgaagtgctgggcgtggacggcgccggtgctgttgtgaaagggggtatggtggaacacgccgagcggggccctgttgccgcaggtcgcaagagttgattacgctctagacctagcacagccgcgaagcaagcgatctctgcggttcggcgcacccccgagatttctgggccatcctggtctatctcaattctcaccaaggctttcgccgggcagcagtcccatagatcgctgcactcgccgagacctacccgtcacggtatgacgggcagggataccgtcgagctgccgtgccgcattaactcccgcgccgctgctgcgaagcgggttccgagggcacccggcccaggatgcagttccgggtggactcgggtttttccgacggaaggaatccattgagcgacaccaccgacgtgacgtcgggtgtttctgacgtcgctgacggcgccggcaccaccgcgaccgccacgaagcgccgccgcggcggcaccgggctgtccgcgatgctgctgcccgagttgcagagcctcgccgcctccctgggcatctccggcacggcccggatgcgcaagggcgagctgatcaccgcgatctccgagcggcagagcggtggctccgccgcggccgagccggctccgcggccgcggaccgaggccgccccggcccagtcggcccccgcttcggccccggctagctagctagcaccccccgcgaggccaccccggtgcaggccgaggccgccccggccgtcaccgagccggccgccgtggccgctcccgtggccgacaccaccgagcgcgccgagcgcccggagcgtggcgaccgcacccgtgaccggcagcgcggtgagcgcaccgaccgcggtgagcgcaccgaccgcggtgagcgcaccgaccgcggtgagcgtccggagcgggccgagcgtgccgaccgcggtgaccgcgccaacgagcgcggggagcgcaccaacgaccggggcgaccgcaacgaccgcggggaccggaacaacgaccgggtcaacgaccgttccggcgaccggggcccgcgcaccgaccagggtcacgacgacgacgacaacgacggtgagggtggccgccggagccggcgcagccgttttcgggaccgtcgccgtggccgcgaccgcgacgacagcccgcgcgaggacaaccggcgtgacggtggcggccgtgagccgcacgtctccgacgacgaggtgctcgtcccggtggccggcatcctcgacgtgctggacaactacgcgttcgtccggaccaccggttacctctccggcccgaacgacgtgtacgtctcgatgtcgcaggtcaagaagtacggcctgcgccgcggggacgcggtcaccggtgcggtccgctccgccccgcgcgacggcgacgggcagcggcgggacaagtacaacccgctggtccgcctggacaccatcaacgggatggagcccgacgaggcccgccggcgtcccgagttctacaagctgacgccgctctacccgcaggagcgcctgcggctggagaccgagccgcacatcctcaccacccgcatcatcgacctggtgatgccgatcggtaagggccagcgcgcgctcatcgtctccccgccgaaggccggtaagacgatggtgctgcaggctctggccaacgcgatcacccgcaacaaccccgagtgccacctgatggtcgtgctcgtggacgagcggcccgaagaggtcaccgacatgcagcgcacggtcaagggcgaggtcatcgcggccacgttcgaccgcccgccgcaggaccacaccacggtcgccgagctcgccatcgagcgggccaagcggctggtcgagctgggccacgacgtcgtcgtgctgctcgactcggtgacccgcctcggccggtcgtacaacctggccgcgccggcctccggccggatcatgtcgggtggtatcgactcgaccgcgctctacccgccgaagcggttcctcggcgcggcgcgcaacatcgagaacggtggctcgctgaccatcctcgcgaccgcgctggtcgagaccgggtcgatgatggacacggtcatcttcgaggagttcaagggcaccggcaacgccgagctcaagctggaccggaagatcgccgacaagcgggtcttcccggccgtggacgtctccgcctccagcacccggaaggaagagatccttctcggcaaggaggagctggcgatcatccacaagctccgcaaggtgctcagctcgctggagtccggcgccgccctggacctgctgatggaccggctcaagcagacccggaccaacatcgagttcctgatgcagatcgccaagtcgacacccggcgagtaagcagcccgatcgccacgaggcccacccgttagggtgggcctcgtcgcttttgtcgcacaagctgtctgattcggcacgtacgtggtcgtgcgaacctccggtatccctctcctcgatccgccggaggatttcgatgatcgtgcccggctaccgggaccacccgaccgagccctgggacccggacagcccggccgaccccggtgaggcggaggatttcctgcgccggtgctacaccgagaacccccggctcggcccggtcgagccccggctcgccatcatccgcgcgcagatcgccgccaccggcacctacgtgcacacccccgacgagctgacccacggcgcccggatggcctggcgcaacgccagccgttgcatcggccggctctactggcggagtctgctggtcctcgaccggcgccgggcgcggaccgccgacgagatctactccctgctggtacgtcatctgcagaccgccggcgacacccagatccgcccggtgatcagcgtcttcgccccggcccggcccggccagccgtacgcccgggtctggaacgagcagctcatccggtatgccggctaccgcaccgaggacggcgacacggtcggtgacccgcggctgcgcgagttcaccaccgcggttcgggccttcggctggcggggcaagggggaggcgttcgacgtgctgcccctggtggtcgagactccgtccgacgggatccgcctgtacgagctgcccgagcaaaccatctgcgaggtgccgatcagccaccccgagtacgcctggttcaccgagctcgggctgcgctggcacgccgtaccggcgatcgccaacatgcggctcaccatcggcggggtgcactacccgctggccccgttcaacggctggtatctgggcaccgagatcggcgcccgcaacctggccgacgccgaccggtacaatctgttgccggtgctcgccgcccggatgggcctggacaccagccgggagtcgacgctctggcgcgaccgggccctggtcgagctgaaccgggcggtgctgcacagcttcgaacgggccggggtgaagatgagcgaccaccacaccgagtcgcggcggttcctccaacacctgaacaacgaggagcgggccggccgcccggtgccggccgactggacctggatcgtgccgccgatgtccggcgggatcaccccggtcttccaccggtactaccgggagatggacctgcggccggccttctacctcgacgacgaggcggcggcactggcccgtgaagggatgcgcggctgcccgcatccgcactgacgtctcaggcgaactcgttgaccgcgaagtcgtcccggtggcgccaggcggcgtcggtgcggacgtgctccgcgcggacccacttgagcagcttgagggggaagtcggcggccgggatccgtccggtcacccggaccacgtacccctcggaggtctcctcgctgcgctgcgcggcccaggcggcgcacgcctcggagaggctcccgccgcggtagaggagcgggaccatcggcagctccagccggcgggcccagtcgaccgtgtcgtcccagccgagcagggtgtcggtctcgtcccagatgccgaagaccaggaacaccccgggcaggtcggtgtaggcgacgctgcggcgggcccacatcgactcgccgcagacccgccacccgtccggaatccggtacgacgtcatcgcccacaacgccttcgccgggcggtcccacgggtgggtgccggagtcgggggagcgggcgtacatggcgtcgcgggtgaaggtgaggttcccgccgtccatcttctcggtcaccacgagctcgccgtccagccacgacaggtccgtctggatccggtcgtcggccgaggcgcccggggagccgggcagatggcaggtccgcggatacttccgcacctcagaagtccccctccgccacctggaacacggtcaggccgagcgcacgccacatgcgtaccacctgctgccggtcgtcgaacaccccgacgacccgccaccggtcccggatctcggtgtcgaagatctcccgcttgaccaccgcatccttccggctgtcgccctccgggcgcaggaacaggccttcgtacgggacgtcgacgaacagctccagccaggcctccgtctccgcccggcacacctcgtcgcggccggagcagaagacgatggcgtgcccggccgcgtgcatcgcccggaccgccgtgatcaccgccgggttcggctcgtcctcgccgacccggtgccactcgaacggactgcggccggtcatcagcgcgaccgtgccgtcgatgtcgaccagcaccaccggcggcagctccggatccggcgcgtagaccaccccggggccgcccgggtcgacgaacggcaccggcagcggcacgttgcgcccggccagataacgctcgtgcatccggcggatgacgtccgcgccgacccggtcctgctcgggccgcccggcgtcgcgccggacacactcggccagcggcacgtcggtgaagtcgtgcacctcgaacgacgcgccgtagcggacggcgagctcggcccactcccggaccaccctggcccgcagattggtgtcgtccacgatcaccgaggcccgggcgcgcagcagagcctcgaccgcggcccgctgcgcgtgcgtcacctgcgactccgaccactgggtgaagagccgctcgccgtgcagcatccgccggaggtcgtcccggttgacccggaccacccccggctgcagcttccgggcgaacgtggtcttcccggacgcgggcaggccccgcgtgatcaacagtcgtgtcattcctcggttcctccagcggccgcccggtcggcggacggtcgcacccgctgccacagacccggacggtaatcatgaccgtccaggcgctggaacagctcaccccggtgcgggctgcgcaccgcggccagcgcgaactccttgcgcccccacccgtcgggcagggcggcgacgatgccggcgtaggccgcctcgaccgcggcggcgcgcgcctcgacctcggcggtcagctccgcggcgacgccacgggcccatacgtggaactcgtccggcagcggctccagcagggcgtcgaggtcaccaccggtggcgaggatctcccagacgctgcgcggggtgaggccggtcaccaggcgatgcaggcgtacgtaatccgcgtatttgatctttacgcgctgatcggcctcggtgaagtggacgaccagcccttcccggccggcgcgcggcgcggcggcgagcgcctcggccagcgtcgcgtagccgaacgtctcgaccaccgggcccggccagtccggcaccgcggccgggccgtgcgagcggccggtggcgatctccacggcgccgagtagcaccaggtcgtcgagcccctggtagtccaccacgatccggttggccggaaagatgatctccacgagcacggtgaggccgtccggcggcgtgaacgacccgtaccgggtgcgcaacagtgtggtggcatggatcgcctggtcggaagcgaacgaccccctcgtggcgacggcgtagccggagccgtcgtggtagatgatgcccaggctgccgtcgaccttgtcggtgaccgccaccggcgcggcggcgtccagggccggtgcctgcgcctcggtgtggttgaagaacttggtcagcggccgggccacgatccgtcccgacgcgtccacgatcaggccgcggcaggccagcgtcaccggtgtccacgcgccggagtactggcaggcctcggtgtagttgtagatggtcagcggcaggtgggggtgacgctgcgtccggaccagcccgttctggaccgcttcggtcagcgtgaccggatcgaagacgtcgtgcagcagcgtcatggcagggtctttcgtgagcgggaatgacgggaaggccgctcacgttatggcttgcgaaaccagttgcacctcctgatttccggccggtacgggaggcatggcagactggtacatcggccagtaagggttccggttcccgctctcactcatcacagagcgacccggcggcccgcatcatcgagagggaccgagaagacatgaagagcggtatccacccggagtacacgaccaccgaggtcatctgctcctgcggcagcaccttcagcacccgtagcaccgccaagggcggcgagatccgcgtcgagacctgcagcgcctgccacccgttctacaccggcaagcagcgcgtcctcgacaccgcgggccgggtcgcgaagttccaggcgaagtacgccaaggtcaacgccgcgaagaagaagtaactgcttcaacggcgcccgtcccggagaaccggggcgggcgccgttcgcatgtgcgtccgtttttccaggcccggagattgaagaagatgagcaacgaccgtttgagcacgcttctcgccgagtacgcggacctggagaagcggatggaggacccgtcgatccacgccgaccaggcgctggtccgccgggtgggccgccggttcgccgagctggcgccgctctacgcggcgcacgccgagctggaggcggcccgcgccgatctggccgccgccagggagctggccgccgaggatccggccttcgccggtgaggtggaggcggtcgccgccgtcctcccggcgctggaggagaagctcggcgagatgctgatcccgcgcgacccgagcgacgccaaggacgtgatcatcgagatcaaggcgggcgagggcgggcaggagtccgcgctgttcgccggcgacctgctgcgcatgtacacccggtacgcggaacgccgcggctgggtggtcgaggtgatcgactcgcaggagtcggacctgggcggcgtgaaggacatctcggtcgcggtgaagaccaagggggtgccggagggcggtcacggggtctggtcccggatgaagtgggagggcggcgtgcaccgggtgcagcgcgtcccggtcaccgagtcgcagggccggatccacacctcggcggccggcgtgctggtgctgcccgaggccgaggatgtggacgtccagatcgagccgggtgacctacggatcgacgtctatcgctcgtccgggccgggtgggcagtcggtcaacaccaccgactccgccgtccggatcacgcacctccccaccggcaccgtggtgagctgccagaacgagaagagccagctgcagaacaaggagtcggcgatgcgcatcctgcggtcccggctgctcgcccaggcgcaggaggcggcggacgccgcggccggcgacgcgcgcaaggcgcaggtgcggacggtggaccgctccgagcgggtgcggacgtacaacttcccgcagaaccggatcaccgaccaccggatcggctacaccgcgtacaacctggacctggtgctcggcggtgagctggacgcggtgctggacgcgctggccgaggcggaccgtcaggcccggctcgccggtgacacggagctcagccggcggtagtgagcccggcggcggcgaccaggtccgtcacgccgagccggccgccgccgtagcagagcaggcgggggccggtcatcgagcaggtgtcggtccggccgggaagtgagccgagcagcgcttgccggccggtcgccggatcccagcgggcgaccgcgacgtggttcaccggcgcggtgacgtcccgcagcaccaccagatacctcttcccggtcacggtcagcaccgcgccgccgggcggcgccgtcgccaccgtggccccggtccgggagtccaccacggtccaggcggactgctcgtcccggctgccgaccagcagatggccgtcgtcgatccgctcgatggaggactcggccagctgccagcgccgcgcgccggtcgccgggtcgagtgcgatggtcagatgcgtgtcgctgacgcacaccaccgggccgcagtcctgcacgtacaccgctccggaggcggtggcccgccacgtctcggtcagtgtgtccacccggtaggcggtcaccgcggtgtcggccggggtccgccggatgtcgtagaacaggccgttgagcacctggggttgccaggacgagccgggggtgccggcctgcggcgggtcgatccgccgggtggccagcggcaccccgtcgctgaggcgcagcgtggtgatctcgccgccggtggtgtcgaagacgatccgcccgttgtcgaccacggcgttctccaccggggtgatcgggcgctgccagagctccgtcgcgtcggtggcccggaccaggtgcagcctggtgatcagaccggtgtcgtcgcggtcgccgagcagcacctcaccggcggtggcgcccacctggtcgccgtcgcgctgccagatggtccggccggtgtggccgtccaccgccatcgtgccggtgccgaaataggccaccccgtcggtgagctgcacggtccgggtgtgcagcgcggagtagagccggccgttctccgggctccacgacaacccgttcgggaactcgccgtgggtggccgcccagcgggtcgcgccggtggccgcgtcgagcgccctgacctccggtctgcccgggtcgccgctgttgatcaggacgatgtcctggacggcgtacgggtaggagtccaccgggaccgtggcggaccagctctcggccagggtgggtggcgcggggcgggcggcaccgcccaggccgaccgcgcagagcacggccagcccggccgcgaccgcccggctcacggtatgccggcggaaccggaactccggtcccggctccggctcggcgtccggcggacccacctggcccagctcgatcacggtcatcgtgccgtcgatcctatgaccggggtcatatccgggcgaccggcgcccggtctgcctcgtggcccggcgcccggtctgcctcgtggcccggcgcccggtctgcctcgtggcccggcgcccggtctgcctcgtggcccggcgcccggtctgcctcgtggcccggcgcccggtctgcctcctggcgcggcacccggtcaccggagccggcgcagcgccgggtgtcgacgatcgccgcgggccggctgaccagctcggccagggcgaccgccgccggccggacccgccaccgggggcggcggccggacgtcggccggcgccggctcgcccggtccggtgacggtcatctaggtcggtttccggctcgccgcggcggccgccagggcggcgccgaggccccgcccgttggtgcccacctcggaccagccggcggccagcccgatcggggtgccggggaccagcacctgccagttctccgcggccgcggcggcgctgatccggcgggacacctcggccgcctggtgcgggccggcgcccggcagcaccaggacgaactcgtcgccggcgaaccgggccacgaagtcgccgcggcgcatcacccgggccagcaccccggcgatccgctgcagcaccaggtcgccgcagtgtcggccgtgccgcatgttgaccgtggtgaacccgacgatgtcgcagaccccgatcgcggcgcgctcgccccgggccagcagggcgtccacatagtgctccagctggcggcggttgggcaggccggtgagcggatcggtgagcgtctcgtcgccgtagcggtgcgggtcgcgctgggtctcctgggcgtccagccgggccgcgaccccgtccagatagccgtcgcggagctggtcgatgcgctgggcggcgagccggaacgcgtaccggtcggcggcgtgcgcggcggcgtggtcgcccgcgctggcgtggcagatgctgcgcaaccgggccggctcgggggcgcccagcacctcggccgagaccggcaccgtctcgagcatggtgagcgcccgctccggcttgccggccgcgatggtcaggcagaccgcgccgaggtgctgcaggtcgcgggtgcggacgctgtcgccgccgccggtcagccagcgggccgcgccgtcctcggtgggctcgcccagggccgcgcggcgggccagcgcgtagccgtagaccgcgcggctgcccgggcgcagctggtcggtcgcgacgtaccgggacagctcggcgtcgatgtcgcgcagcacccgcaggcagccgtcggtgtcgccctggtggtcgagggagaccgcgttgcgcagccggatgccgggggcggcgaacacctcgggggtcagcccggcgctcgccccgacctcgcgggcctgctcgatcgcggtcagcgcctggccgtggaagccgagatacgaatacgccatggcgaggtcgtgccagccccaggcggtctcctcgtcggcctccggcaccgcagccagcgagcgggcggcctgcaccaggtgggtcaccccgcggtccagattgctctgcaggtgggcgccgagggcggcgaaggcgtgcatctggccacgcagataggggtcggggacctcgcgcaccgcctcggcggccgccgccatcgcgaccgcgagctcggcgacccggcccaggttgatcagcgcaccgaagcgctggatcagcgcgtaggcgcgggtggtcggatcggtggcggtggacagcaccgcgtccaggatcggcagggcctgggccgagcggccgttctgctgcaggcccccggcccggcgcagatcatcggcatgctccgcgagctggtccaaccaacccaccaggcgcctccccgggctcggcgcggcgctgggcgacccggccggtccccggcgtgcgcgacgtctcatgattatgccgtgacaccgcctgacgaacacccccgccggacccgtctggcacccgaactcgcatcggcggccgccgaactctccgcgtccggtgtgtcctctccgcgggtcgacgccgagttgctcgccgcccacgtgctgaatgtgccccgcgggcggctgatactgatcgacgcgatccgcgcggacgaggcggcccggctgcgcgagttggtcgccgcgcgggccgagcggatcccgttgcagcacctgctcggcacggccgcgttccggcacctggagctcgcggtcgggcccggggtcttcgtgccccgcccggagaccgagctgctggccggctggggcatcgagcggaccgcgccgggcgcgctggtggtcgacctgtgcagcggcagcggagcgatcgcggtgtcggtggccaccgagtcgggcgccggccgggtgctcgccgtggagcggtcggcggacgccctgccctggttgcggcgcaacagcgcgggcgtcggcaacctggaggtggtcgaggccgacgtgaccgatccgggtctgctgtccgacttgcacggtcaggtcgatgtgctgctctgcaatccgccgtacgtccccgacggcaccccggtgccccccgaggtgtccgatcacgacccggccgaggcggtcttcggcggggccgacgggctgtcggtgatccggccggtcatcgcgaacgccgcggcgctgctccggccgggcggctggatcggcgtcgaacacgacgacgtgcacggtgcggcggtgcccggcctgctgcgcgcggacggccggttcaccgaggtgaccgcgcacgacgatctcaccggccggccccgatacgccaccgcccgccgccggtgacggcatggcagactgcacgtcgtgatgctctacgactgcaccgccatcgccgatcgtgatcgtggcatcgcggcggccgtcgaggcggccaggagcggtgagctcgtggtgctgcccaccgacacggtgtacgggatcggcgccgacgcgttcacctcgcacgcgatcacccagctgcaccacgcccgcggctcggaccgccgggtgccgccgccggtgctggtcggctcccggcacaccctggacgggctggtctactcgctgccccgggccgcccgggacctggccgacgcgttctggccgggcgcgttgaccatcctggtggagcattcgccgagcctgcagtgggacctgggggagaccggcggcgtggtcgccgtccggatgccgctgcacccggtcgccctggaggtgctgcgcgaggtcggcccgatggcggtcaccaccgcgaacaaggtcggctcgccctccccgctgaccgccgaggaggcccgcgaccagctggagtatgcagcgcgcgtctacctggaggcgggcccggcgaccgacccgtggccgagcacggtggtcgacgtgaccggtgacgtgccccgggtcctgcgggtcggctcgatcccggtggaaaaactgcgcgacgtcgttccggagatcgtcgaggggcaggcctgaggtggcgccgttcaccgtcctgcacatctgcatgggcaacatctgccggtccccgatggccgagcggctgctcgaccgggcggtccgggaccgggccgagacgtccggcggcccgttgctgcgcagcgtcagcgccggcaccggcgggtggcacgagggcgaggagatgaatccgccggccgcccggcaggttcgcgcccggcgtggctccgacgacggcttccaggcgcgcaagctgcgcggcgacttcatcgacgaggccgacctgatcctcaccgcgaccgccgaccagttcgactacgtggtggcgctgcgcccggacgccgccgaccggacattcgtgctcggcgagttcggccggctgctcggcgcggtcgacgccgccgcgctgcccccggccaaacccgaggcggagtcggtccaccagcgcggggcggccatcgtcgaggcggtggcccggctgcgcggcgccgaggcgccgctgctcaccgacgacctggacgacccgtggggccgcggcgaccagaccttccagcgggtggccgacgagatcgaggacaccaccgtcccgttcgccacgttgctgctcccgtgagccggcttgccccgccggacgccgcgggcatcgaccgggcggtcgcgattctgcgcgccgactcggtggtcgccttccccaccgagaccgtctacggcctcggtgcgaacgcgttctcgaaacaggcgatcggcgaggtctaccggctcaagaaccggcccgcctggaacccgctgatcgtgcacgtggccacggtcgaagcggcccgtgccctggccgccgagtggccggccgccgcggacgcgctggccgcacggttctggcccggcccgctcaccctggtggtgcgccgcgccgcgcacctggccggggtcggcgcggacaacgacacgatcgccgtgcgcatcccggcgcacgaggtggcgctgcgcctgctcgaggccagcggactgccgctcgccgcccccagcgccaaccgctccgagtcgatctcgccgaccaccgccggccacgtgctgcgcagcctgcccgacgtgccgctggtgctcgacggcggcccgtgctcgtggggcatcgagtcgaccgtgctggacctgaccaccggggtgccgacgctgctgcgcccgggcgcgctgagcctgcgcgcgctgcgcgaggtcaccggcacgatcgcgctgcgcgacacggagaccgcggacggcacggcccggccgtcacccgggatgagccgccggcactacgcgccgcgcgccaggaccatcatgctgccggcgctgcgggaggcggaccggtccgggctcgccgggcccgtggcgatcctgtcgtacgagggttgccccaccccgtcgtacgacctgatcgagatcctctccgccgacccccgtgagtatgcggcggacctgtacgccgccctgcaccgcctcgacgacgcgggcgccggcacgatcctggtccaggagccgccgcgcaccgaggactggctggccgtccgcgaccgcctgtcccgcgccgccgcctagcctcgcgggcccgcaccggcggagccggcgcgggcccggattgctcatcccaccggtcgcacgagctcgccggaccggttgccggcccggtccaccgcgatgacgtggacggtgtgcggccccggcgacaggccgtcgagcgggatcaccccgcggccgaaccggacgtcgacccatcccgcggcgtcgctgtcggcgggcgcgtcgacggcgtaccggaaatggtcgattcccgactcgtcgaaggacccgaccgtcagggcggccggagccccggagtccgggacggtcgccgggtaccgccgcacgccgccgctgtcccagcggaccagcaggtctccccgcggatcgcggatcatgtcggcggcgccggtccaggcgcccaccgggaagaccccgtcccgggtggtgaacccgccggcgtcgtcggccacccgggcggtggcggcgccgtccgcggtgcgcagcaccacggcccgatgcccgtcgatcgtgtcggcgtacatgccgaccgtgccggtgtcgccggccggccggatcaccaccggcacgccggccgtcaggtcgccggacgccggactgccgagcaccggacagccgagtacccgaccgtcggcacagcgcagcaccaggtcgtcccggccgtcgccgagcacgtcaccggcggtcagctcggcgatgccgcggccgtcgcaccagccgccggacggcgccgccaccggctgtccggggtgcgccggcgactgcccggcccggaacggaacgggcaccaccgagaccgcgtcggtcccctgccggatcaccacgtcgtcgagccggtcgccgaggttcagcggtgccatgtcgcggacgtcgtcccaccgcaggtagccgccgtccggagccatcgccggggtgaccgtgccggtgtcccagcgggccaccacggcgggcgcctccgggtcggtgaacaggcccgccgtcaggtgggtcgccccggcgaagccgaactcggcgtccgccagcgcgggttgttcccgcgtcccgtcggcgccgatccggtagcggtgcaaccggccgtcgtcggcgggcgccgccctctgccgccggccacgggtgaccaggtcgtccacgccgtcgccgtcgaaatcgccgagcgccgtggcggcgaccacgttccggccgtcggccgcggccgcctggacctgcgcgaagggctggaaaccgctgctgccgccgggataggcgtacaggctgccgctgttccagcggacgaagaggtcgtcgtagtgatcagcggcgccgggccgcgggccgtacgcgtcgccgaaggcgatgtgccgcgcgtccgtcaggctgccggccggcatcagctgccgcgccggcgcggccgtggccccggtgatggtgatcgcggcgagcgagccgtcgtcccggcggatgatcaggtcgtcccggttcttcgccgggtcgccgtcgacatccccggcggtgatctccgtgacgccgttcaggctccacaccggcagcaccggcgtgctgacccgcaatccgtccttgccgtaatagacgaacagactgttccggctccagcggaccgcgagatcggcgaggtggtcgccgtcgaagtcgccggcggcgatcccggccgcgtccgaccagccgctgccctgggtgctgcgcaccaccacgggccgccccagccggccgccgggcaggccgggatacaggtcgacggcgccgtcgtaccagcggaccaccaggtcgtcgatcgcatcggcggtgaacttcccggtcaccatgtcggtggccccggaccagccgctccgggaatccggaaccagctggtcggcggcgggctggacgaccggtacggccggcggctgccggtcgtcggcccagaccgcctcgccgcgcaggatcttgtgatcgcggcggctgaacccgggatcgacggtgtcgccccgcacccagcgcacctgcgcggccgagccgaacatgtagtcgaacttgcgggccggcttgggcctgcccgcctcgtcggtgccggcgaaggtggtggtttcgccggaccggcagaacgccagttgccggcacccgtcggtgaagtaggcgcggtcctgctcgtcgacctcgcggaaggcgccggtgccgccgccaccggagtagaacgcccccaggttcgggtcgaacgggtcggcgttgaagtcgccggcgaggatgatcggccggccggccgcccagctggtcatctgcgccgcggcctccggcatgccctggtcgacgctcaccgtgtcgaggtgcaccgtgcaggccagactgtcccggccctggacgacggtgcccatgcagagcacttcgcgcttctcctcggaggccgccgtcgccgtccggccctggtcccacagctcggtcagctcgtgggagtaggtggtggccggcgaatccgtgcgcaccagcacggcatcaccgaagtcgtcgtcggcggtcaccccgggcaccagccacttgtcgcaaccgttgtccccggaccggttcgtccaccaggcgatccggtaattcgccgggagccggtgggcgagcaactcccgctgccccgcgcacatctcctggaacacggcgacgtccgagtcccaggcccggacctgctgggcgacccggtcggcccaggtgtccgccgcctccagtggccggcaatcggcctgatacgacccgcacacattgaagctcagcaccctgaccgaccgggctgtcgcggcttcggcccgtccaccgggcggtccgaacgccagcaccatcagcgcgacgatgaacgccgccatcccccgttgccttgcgaagatcatgcgaaagtgtgccacggcatcgacgtccggcactgccccggtcggctaggcgcggcggatcgcgtccacctcgatctcgatcttcatccgctcgtccagcaggccgcagaccagcatcgtcgcggccgggcggacgtcgccgaaggcctcgcgcagggccgggccgcaggccgggaagtcggccgcgtcggtgagcaggtagcggacccggaccacgtcggcgagcgagctcccggcctcggccagcgccgccgcgatgttccgcaggcactgcgcggcctgctcaccggggtcgtccgagatggtcatcgacgcgtagtcgaagccggtggtgccggagacgaacacccggtcgccgtcggccaccgcccgggcgtaggcgaactcctcctcgaacggcgaaccgctgaagatcctcaattctccgctccccgggcgatgttgcgggccatgccgttgaacacgatgccatggaacggccagaccgacgcccagtagagatgcccggccagcccgtgcggcaggaacaccgcccgctgccggtagaccgagccgccgtcgccgtccggctcggcgcgcatctccagccaggcccgtccgggcacccgcatctcggcgcgcagccgcagtagccggccgggcacgatctcctcgacccgccaccagtccagcgcctcgccgacccgcaggtgttcctggtcgcgccggccgcggcgcaggccgacgccgccggccatccggtccagccagccgcgcaccgaccaggccagcgggaacgagtaccagccgttctccccgccgacgccctcgatcacccgccacagccggtcggccggggcgtgcacctcgcgggcccgctcgtcggtgtagatgctgccgccggaccattccgggtcgctgggcagcggctcggcggcgaagtcccgcccggaggcgccggtccagcgggtctccacgtccgcgtcccggatccggcccagggccagccggaccgactcgtcgaagccgagcggcggcgggccgggcagcagcgtggccaggtcgttctcccgggccaccgcctcgtgcaccaggctggccaccagcgggcgggcgatcgcgttcggcaccggggtgaccaggccgacccagtgcgccgacagccacgggctgagcacccgggtgggcagcaggacccggcggggcaggccggccacgaccgcgtaccgccgcatcatctcggcgtaggtcagcacgtcggcgccgccgatgtcgaagccgcggtgcacgtccggcggcaggtcggccgcgtcgatcagataccgcagcacgtcgcggaccgcgatcggctggatccggttgtcgacccagcgcggggcgaccatcaccggcagccgctcggtgaggtaacgcagcatctcgaaggaggccgagccggacccgatgatcaccgcggcccgcagcaccgcggtcggcacgccgccggccagcaggatccgggccacctcggcgcgcgagcgcaggtgcggtgagggcacgtcgccgggcggcggctccgggccgccgaggtagatgatccggcgtacgcccgcggcccgggccgccgcggcgaagttggccgccgcctcccggtcgcggcgctcgaagtcaccctggcccagcgagtgcaccaggaagtaggcgacctcgatcccgtcgaaggccggcgccagggtggccggatcggcgaggtcgccctcgacgatctccacctggccggcccacgggacgtcgcggaggcggccggcgctgcgggacaggcagcgcacccgatggccggcctcgaccagccgtggagccagccggcccccgatgtacccggtagctcccgtgacaagacagcgcataactccagactgtgccccgaacgggggtgcttcagccatatgctcgatccaggccgcgttcgccgagctcgggaggcctggtggaaacgttctggggtccggatttcgccgcgctggagcgggacgacccggagatcgccgacgtgctgctcgacgagctgacccgccagcgcgagacgctgacgctgatcgccagcgagagcttcgcctccccggcggtgctggccgcgctcggctcgacgctggccaacaagtacgccgagggctatccgggcaaccggtactacggcggctgcgagcacgccgaccgggccgaggagctggcggtcggccgggccgtcgagctgttcggcgccgaccacgcgaacgtgcagccgcactccggggcctcggcgaacctggccgcgtacgccgcgctggccgagccgggcgacccggtgctggcgctgggactgccgcacggcgggcacctgacccacgggagccgggcgaacttctccggcaagtggttccacccgatcgcgtaccgggtcgacccggccaccgagctgatcgactacgacgaggtgcgcgacctggccctggcgcaccggcccaagctgatcatctgcggcgcggtgtcgtacccccggctgatcgacttcggccggttccgggagatcgccgacgaggtcggcgcctacctgatggtcgacgcggcgcacctcatcggcctggtggccggccacgccgtgccgtccccggtgccctacgccgacgtggtcacctgcaccacccacaaggcgttgcgcggtccccgcggcggcatgatcctctgccgggccgacctggcccggcgggtggacaaggcggtcttcccgttcgcccagaacgggccgatgatgcacgcggtggcgggcaaggcggtggccctgcgcgaggcgggcaccgcggccttccggaggtacgcttcgcagaccgtgcgtaacgcgcaggcgctggcctcctggctgaccgccgaggggatgcgcccggtgaccggtggcaccgacacccatctcgccgtgctcgacctgcgcgagctgggcgtcagcggccgggacgcggaggcgcgctgcgccgccgccgggatcgccgtcaacaagaacgccataccgtacgacccggagaagcccgccgtggcctccgggatccgggtcggctcgccgagtgtcacctcgcagggcatgggggaggcgcagatgcgccggatcgcggagctcgtcgggatggcggtgcgctgcgatccggagacggccaccgggacgacccggctggccgccgtcggcgaggaggtgaccgacctggtgcggcgcttcccgttctacctgaagcaggaggttctggcgtgagcggcgtaatccccgcggcggtggagaaggacgtggacgacgaccttccgctgcccgatctgccgcccctgcccgccgacccgcgctggaaggtcgagcatctcggcttcctgaccgcggtctcggtcgcgctgctcctgtgtgccgcctcggccggcttcctgtccggcggtccggcctacgccctggccgcggccggtggcgtgctgatcgtgacggtcagccacacgctgaccacgctgatcgtcgcctgggccgacacggtccgcccggccctggtcatgccgctgggaatgttgacgtatgtcgtcaaatattctttgttcgggattattctggcgtttggcgtctcgtccgattggcctgccaagacggcgctggggctcggtgtcgtggccggggtcatggtctggaccggcgtgcaggcctggcaggtaacccgggcgacactccgaaggtgatctgcagcacgaatatcaccccagctcagcggaggtttagctgatcaactgccacgatccggtgatgtgtcccgccgtgccttgttccgttttggcgcgacaggagtaccgtgtgcttccagttgcgagacccctgacgcctggacaactgcggttgtgcggggggtcccgcttagcttcgtattagctgctgatatcgttcgggccgtcatgaccggccaagaacctccccacgacaaacgcggtgacgaaggccccaccccgcccgattccggtgcgggcatgacggcagtcacctacctcatcgcgggcatgttggtctggggtgggatcgggtggctggtcgaccactacgtcggaactgagggcatcttcgccggcatcggcgcggtcctcggcatcggcctaggtgtgtacctcatcgtgcgccggctcggcgcctgacaggaagggccatggtgatcgttcagtcggcggtcctcgcggcagagttcccgcccagcgtcgaggacttctacctgcccagcatcctgccgtggggcgcggagagcaattactggttcaccaagatcacggtgctcgtctggatcgcggtggcggcgatcatcgtcttcttcctggccgcgtaccggaagccgcagctggtcccgaccaagaagcagtggctcgccgagagcatctacggcttcgtgcggaacaacgtcgcgatcgacatgatcggtccgcgcggggtcaacttcgcgccgtacctcaccacgctgttcatgttcatcatcgtgaacaacttcttcggcatcctgccgttcgtgcagctctcgccgaactcgcacatcgcgttcccggcgttcctcgcggtcatcagctatgtgatgttcatctatgtcggcgcccggaagcacggcttcttcaagtacctgaagcacgcgctgatcccgccggccccgtggttcatcctgccgctgctgatcccgatcgagttcttctcgaacttcctggtccgcccgttctcgctggccgtccgtctgttcgccaacatgttcgccgggcacatgctgctgctggtgttcacgctcggcgggttcgcgatgatcagcgccaacggcttcctcgccccggtgtcgatcctgtcctgggcgctgagcatcgcgctgaccttcctcgagttcctggtgatctgtctccaggcctacgtcttcacggtgctgacggcgagctacgtccagggcgcgctcgccgacgggcactgattttgtcccacccgcaacaccccgtttgtcgtcccgcgtgacagtcacgcgagataccaggaggaactgagaatgctgctctccgaagttgttggtagcaccgccgccatcggttacggtctcgctgccatcggcccgggtatcggtgtcggtctcgtcttctcggcctacatccagtcgaccgcccgccagccggagtcgtcccgcctgaccctgccgtacgtctggatcggcttcgcggtcgtcgaggcgctcgctctgctgggcatcgcgttcggcttcatctgggccggcaagtaactccctctgcctcgttgggaggtctccatgctcacgtatttggctgaaggggccgcgaagacgccgaacccgatccttcctgcctggcaggagatcgtcgtcgggacggtcgcgttcatcgtgctctgctttgtcctgatgaagttcgtcttcccgcagatggagaagacgttccgcgctcgcgtggacgcgatcgagggcggcatcaagcgtgccgaggccgcccaggcggaggcgaacgagctgctcgagcagtaccgcgcgcagctcgccgaggcccggaccgaggccgcccgcatccgcgacgaggcccgggccgacgccgagggcatccggcaggacgtgctggccaaggctcgcgaggagtcggaccgcatcatcgcggccggcaacgagcagctggccaaccagcgcgagtcgatcgtccgggagctccgtgccgaggtcgggacgctggccgtggacctggccggcaagatcgtcggtgaggcgctggccgacgaggcccgcacccgtggcaccgtcgagcgcttcatcgcggacctcgacgccgccggcacggcgggcgggcgctgatggcgtccggcgtgaccaaccaggcctacgccgacgcggcggagcggctgcacgccgccaccgccacgtcgacgggcgcgcagctggccacagtcgccgacgagatcctgtcggtggccggcctgctgcgcggtcagccccggctgcgccgggcgctgaccgacccgtcccggcccggcgaggaccgcggtgatctgctccactcgctgctgtccggcaaggtcaccaaggtgaccgtcgacgcgctggccgccctggtggccggccggttctccaaacccggcgacctgctggacgccaccgagcggctgggtgtcgacacgctgctcggtgccgcccagaaggacggcaagctggcggaggtcgaggacgagctgttccggttcggtcagatcgtcgccggcagcccgcagctggtggccacgctcagtgacatcggtgcgccggtcgcgccccgggctaagctggtccgggatctgctcgacggcaaggcgcagcccatcacggtgtggctcgtccgggtcgcgctcgagggattcggtggccgtggcttcgaggcctcgctgacccggctggtcgagctgaccgccgcccggcgggaccgtgaggtggcgtatgtgacggttgcgaagccgatcaccgacgccgaggagtccgcgctgggcgccaagctcgccgcgatctacggtcgtgaggtctcgctgaaggtggacgtcaatcccgccatcatcggcggggtcagcgtccgggtcggctcggatctctacgacgggacgatcctgcggcggctgaacgccgccaagcaggcgttcgccaaatagtctttttcccctcgatttcctatcgagaagcccctcggtggcggcgacgtcccgagctagacagagaaggcagaggatggccgagctgaccatctcctcggacgagatccggggggcgctagagcgctacgtctcgtcctattcgcccgaggtctcccgcgaggaggtcggcatcgtctccgatgcgggcgacggtatcgcgcacgtcgagggcctgccctcgacgatggcgaacgagctgctcgagttcgccgacggcacgctgggcgtcgcgtcgaacctcgacgtccgtgagatcggcgccgtgatcctgggcgactacgcgaacatcgaggagggtcagccggtcaagcgcaccggccgggtcctctcggtcccggtgggcgacgccttcctgggccgcgtggtcgacgccctgggccagccgatcgacggtctcggcgagatcgcgaacgaaggcttccgcgagctggagctgcaggcgccgaacgtgatggcgcgccagccggtgaagcagccgctgcagaccggcatcaaggcgatcgacgccatgacgccgatcggccgtggccagcgccagctgatcatcggcgaccgcaagaccggcaagaccacggtcgcgctcgacacgatcatcaaccagaaggcgaactgggagtcgggcgacccggccaagcaggtgcgctgcatctacgtggcgatcggtcagaaggcctccaccgtcgccagcatccggggcaccctggaggcgcagggcgcgctggagtacacgacgatcgtgtcggctccggcctccgacccggccggcttcaagtacatcgccccgtacaccggctcgtccatcggacagcactggatgtacaacggcaagcacgtcctgatcgtcttcgacgacctgaccaagcaggccgaggcgtaccgcgccgtgtcgctgctgctgcgccgcccgccgggccgcgaggcctacccgggcgacgtcttctacctgcactcccgtctgctggagcgctgcgccaagctctccgacgagctgggtggcggctcgatgaccggtctgccgatcatcgagacgaaggccaacgacatctcggccttcatcccgaccaacgtcatctcgatcaccgacggtcagatcttcctcgagaccgacctgttcgcctcgggtgtccgcccggcgatcaacgtcggcacctcggtgtcgcgcgtcggtggctcggcgcaggtcaaggcgatgcggacagtctccggccggctccgtctcgacctggcccagttccgtgagctggaggccttctcggccttcgcctccgacctggaccgcgcgtcgcgggcgcagctggagaagggcgtccggctggtcgagctgctcaagcagccgcagtactcgccgtactcgacggtcgaccaggtcatcgcgatctgggcgggcaccaccggccagctcgacgacatcccggtcgccgacgtccgtcgtttcgagcaggagttcctgcagtggttcaagtcgcaccagagcgacgtctacaccgcgatcgagtcgacgaatctgctgaccgacgacaacctcgagtcgctgaagtcgggtgtcaccgagttcaagaagtcgttccagtcgagcgcgccggccgagagcggtaactgagcatggccggtcaggtacaggcgctgcgtcggcggatcaagacggtcaagtcgaccaagaagatcgccaaggcgcaggagctcgtcgcgaccagccggatcgcgaaggcccaggaacgggtcaacgcgtcccggccgtactcggtggcgatcaccaaggtgctggccgccctggcgtcgaacgcgtcggtggacaacccgctgctggtcgcgcgtgagcgcgtccagcgggcgggcgtcctgctgatcaccagtgaccggggcctggccggcgcctacaacgccaacgccatccggaccgccgagcagctgatcactcagctccgctcggagggcaaggaggtggcgctgtacgtggtgggccgcaagggggccagttactaccggttccggaaccgggagatcgcggccagctggaccggcttctcggagcgtccgaccttcgccgacgccaagaagatcggtgacggtctgatcgaggcgttcgcggccggttcggagaccgcgggcaccttcggtccggagggcatcgccggcgtcgacgagctgcacatcgtgagcaccgagttcaagtccctgatgacccagaccgcgaacgccaagccgctcgccccggtccaggtcgaggacgagaccgaggggcagtccgacgggctgcgtccggcatacgagttcgagccggacgccgacgagctgctcgacgcgctgctgccgaaatacctcaacacgcggatctacgcggcgttgctggactcggcggccagcgagtcggcctcccggcggcgggcgatgaagagcgcgtcggacaacgccgacgacctcctcaagcggtacacgcgcgagatgaactccgcgcggcaggctgcgatcacccaggaaatcagtgagatcgtcggcggcgccaacgcgctggccgcggcgggaagtgatgtgtgatgactgttcttgccacctccggtgcatccgagcccaccaaggcggagaccgctgtcggccgtgtcgtccgggtcatcggcccggtcgtcgacgtcgagtttccccgtgacgccatgcctccgatcttcaacgcgctgcacgtcgaggtcaccctctccgagggcaccaagaagctgacgctggaggtcgcccagcacctgggtgacaacctgctccgcgcgatctcgatgcagccgaccgacggcctggtccgtggcaaggaggtcacggacaccggcgcgccgatctcggtgccggtcggtgacgtgaccaagggccacgtgttcaacgccctcggcgaggtgctcaacgtcgacccgtcgacgctggacatccaggagcgctggtcgatccaccgcaagccgccggcgttcgccgacctcgagccgaagaccgagatgctggagaccggcatcaaggtgctcgacctgctcgcgccgtacgtgcgcggtggcaagatcggcctgttcggtggcgcgggcgtgggcaagaccgtgctgatccaggagatgatcatccgggtcgcccgcaatttcggtggcacctcggtgttcgccggcgtcggcgagcgcacccgtgagggcaacgacctcatcctggagatggacgagggtggcgtgctggacaagaccgccctggtcttcggccagatggacgagccgccgggcacccgtctgcgggtcgccctgaccgccctgaccatggcggagtacttccgggacgtgcagaaccaggaggtgctgctcttcatcgacaacatcttccggttcacccaggccggttccgaggtctccaccctgctcggccgcatgccgtcggccgtgggttaccagcccaccctggccgacgagatgggtgagctgcaggagcggatcacctcggtccggggcaaggcgatcacctcgctgcaggcgatctacgtgcccgccgacgactacaccgacccggcgccggccaccaccttcgcccacctggacgcgaccaccaacctggagcggtcgatctcggacaagggcatctaccccgccgtggacccgctggcctccagctcgcggatcctggccccggagttcgtcggcgccgagcactacacggtggcccgtgaggtccagcggatcctccagaagtacaaggacctgcaggacatcatcgccatcctcggtatggacgagctctccgaggtggacaaggtcacggtcgcccgggctcgccggatcgagcggttcctgtcgcagaacacctacgcggcggagcagttcaccggtgttcccggctcgacggtcccgctgaaggagaccatcgaggcgttcaagaagatctccgagggtgagtacgacaactacccggagcaggccttcttcatgtgcggtgggcttgaggacctggagaagaacgcgcacgagctgatgaagggctgatctcagccctcgtcaagtccgacgtacgacgaagccgtgccggtgctcaccggcacggcttctcgttgtgctgggcgtgaaaggtgtcctgggaacgaggaacgtcccgcgctgggcccggctcgccgccgtgttcggctcggtgctgatgatgatcagcggtggagtgctggtcggtgggcgagcgctgatctcgcggtacaccgccgggctggacgccgacggcagcctgatcggcgcgggcaccggtgccgccgagatccggggcccgatcaacattctgctggccgggatcgacccgcgggacgaccacaccgcgccgctgtccgactcgatcatcgtggcgcacatccccgcctcgatggatcaggtctacctgttctccatcccgcgggacctctatgcggccatcccgccgtttccgccgaccggcttcgccgggaccagatcgaagatcaacgccgcgatgtcgtacggcagccaggtcgccggtggccgtcacgacgtgcggcaggggtttcgcctgctggcccagacggtcagcgggctcaccgggatccgggacttccaggccggcgcgatcatcaacttcggcggcttcaaacaggtcgtcgaggcgatgggcggggtgacgatgaccgtggacatgccggtccgctcggagcacctgcggccggacgggcggccccggccccgccggccggagtgcgccgacaactcctgcccgcacccgtacatcgggccgcagaagacgtaccggccgggcacctaccacctgcaggcctgggaggcgctggactactgccggcagcggtacgggctgccgcacagcgactacgaccggcagcgccaccagcagcagttcctcaaggcgatggcgaagcaggcgctgagccggggcatggtgaccaacccggcgcggatgttgcgggtgctggacgcggccggtgacgcgctcaccttcgacggcaacggtcacagtctgctcgactggggcctggccctgcgcaacctgaacaccgacgacatggtctcgatcaaactgcccggcggcgcgctggtggagaacggcacctatctcggcgagcagttggcgcccggcaccggggatttcttcgcggccgtccgggaggaccacatccaggagtttctgctggcccacccggagttcgtgaaccggaacagctagccccgggcgaacgccggcgcccggcgccgtttagactttcacccgaacaggtctgcagcgtcagagggagacagcgtggccaaccaacttcacgtcgaggtcgtcgccgtcgaggagaaggtctgggccggtgaggccgagatgctcgtcgcgcgcaccaccgagggtgagatcggtgtgctgccgggccactctccgctgctcggcctgctcaaggagccgtcccaggtgcgggtgaaactcgccggtggtgagcagctcacctacgacgtcgccggtggcttcctctccatcgacgcgaacggcgtcacggtgctcgccgagagcgcgacgccggccacccccgagcagcactgacctccggcgatgcgggttctggaagttttcgggatctgcctcgtcgcgctgctcgcgctgctgttcgccatcttcttccgccgccggctgctgatgctcggcggcggcaccatccgcctgcaggtccgcaccagcacgatggtgccgggccgcgggtggtcgcccgggctgggccagttcgtcggtgacgagctgcgcttccacaagatgttcagcctggcgttccggcccaagcgggtgctcgaccggcgcaccctggcgatcgccgagcgtcgcctgccgaccggtcccgagcggctcaccatgcccggccactgggtggtgctgcgctgcgccacggccggcgtcgacctggagatcgccatggccgagaccacggtgaccgggttcctgtcctggctggaggcgggcccgccgcgcgatccgggcagtgtgcccggccgctccatcttcggcccccgctccctcgaaagctgacgaccgcctctcgcggattggccgtcgcggacccgcggccgggcgcctagcgtcgggttcatgcggattcgtatcgtcgacgccttcaccgaccgcccgttcgccggcaacccggccggcgtgctgatcctggacggggacgggtttcccgccgccgactggatgcagcgggtggccgccgaggtcaacctgtccgagacggccttcctgcaccgcctcccggccggctcggacgccggctgggcgctgcgctggttcaccccgggcgccgaggtcgccctctgcggccacgccaccctcggcaccacgcacgtgctgcaccgggccgggctgctcgacggcgccgcggtccgctacgccacccggagcggcatcctggcggcgaccgtcgccgccgacggactgatcaccatggacttcccggccgccccgctcagcccggtcgaggtggccccggagcttgccgcggctctcggcgtcgacgccacggccggtttctggaccggcccgaacaccgacgacatcctgatcgagctcgccgacgaggcggcggtccgcggtctcaccccggatttcggcgcgctggcccggcacacccgccgtggcgtggcggtgaccgcccggtccgcggagcacgacttcgtgtcccgtttcttcgccccggcggtgggcgtcaacgaggatccggtgaccggttccgcccacaccgcgctgaccccgtactgggccgggcggttgggccggaccgagctcaccggataccaggcgtcggcccgcggcggtgtggtccgggtggccctgcgtggcgaccgcgtcgacctggccggtcacgcggtcaccacgatcgacggcgagcttcaggtggcgatctccgcctcgtaaccccagccgtcctccaggtacgccgcgtagctgtccggtccgccggcgtgcgggtgccggtcggcgaacatcagcgaccacccgtgcgccggtgcggcggcggccagccggtccacctcggccggcccggccgcggcgaacgccagatggttgaggccgggcgcgagccggtcgtggacgccgccggagagcgccggcgactgctccatcaccaggtaggtgccgcccgggtgccgccaggaccggccgcccggccagtcctggaacggcgcccagccgagctcaccgagcagccagtcccacggccgcagcgacccggtgagatccggcacccagagctcgacgtggtgcagcccgccggaggtcaccgggagccgccgggcacccacttcacgtcgccgtccgggttcgccacccgggagaggatgaacagcaggtcggagagacggttcaggtatttcgccggcagcaccccggtccgctccgggtccgcctcgatcagcgcccacgccgaccgctccgcccgccgggccaccgtccgggccacgtgcagcagggccgcccccggggtgccccccgggaggatgaaactgtccagcgcggccagccgctcgttgaactcgtcgcaccacccttcgaggcgggtcacgtactcctcggtgatccgcagcggcgggtagggcgggttctcgtccagcgggttgccgagatccgcgcccaggtcgaagaggtcgttctggatgcggcccagtaccacgcggacgtcgtcgggaagcgaaccgagagccagagcggtgccgagagccgcgttgcactcgtcggcgtcggcgtacgccgcgatccgtggatcggtcttggccgccacctcgttgttgaccagccgggtctgcccggcgtcgccggttcgggtgtagatacgcgtcagatgcacagccatacgcccaccctatgcagtcccggcgggccccggcccatacgatggcccgcgtggatgtgatcagggtgaagggcggcgcgccgctcaccggggacgtcacggtcggtggcgccaagaactcggcgctcaagctgatggcggtcgcgctgctcggcgagggccgcagcgtcgtcgccaacgtcccccgcatcaccgacatcgcgatcatggccgaggtgctgcgccggctgggctgcgacgtcacgctggagggcaccgacgcggtcatcgacgtgccgctggagccgggcgccgaggccgactacgacctggtccgccggctgcgcgcgtcgatctgcgtgctcggcccgctgctggcccgccggggctacgtgcgggtcgcgctccccggcggcgacatgatcggctcccgcggtctggacatgcacgtctccggcctggccaggatgggcgcggagatctccaacgagcacggcttcgtgatcgcgtcggccccggccggcctgcgcggcaccaagatctggctggacttcccgagtgtcggcgccaccgagaacctgctgatggccgcggtgctggccaagggcgtcaccgagatcgacaacgcggcccgcgagccggagatcgtcgacatctgcgacatgctcaccgcgatgggcgcccggatcgccggcgccggctcgtccacgctggtcatcgagggggtggacggcccgctgcggccggtccggcacaccacgatcggcgaccggatcgtcggcggcacctgggcgtacggcgcggccatgacccgtggcgacgtcaccgtgcacggggtgcgccccgagttcctcgacatcgccctggacaagctggtcacggccggcgccacggtggagccgggggacaacaggttccgggtccggatggccgagcggccccggcacgtcgacatcgtcacgctgccctacccgggtttcgccaccgacctgctgccgatggcgctgggcctggccgcggtcgccgacggcccgtcgctgatcaccgagaacatcttcgacggccggttcatgttcgtgaacgagatggtccggctcggcgcggagatccgcaccgacgggcatcacgcggtcgtcaacgggcgggagcggctgtccggggcgccggtccgggccaccgacatccgggccggggccggcctggtgatcgccgggctgtgcgcggacggggtcaccgaggtcggtgaggtgcaccacatcgatcgggggtacccggacttcgtggccgacctggcgcgtctcggcgtggaggtggagcgcaccgacgtaccggagccgtccttcgatttctagctcgatccgacgaggcggcgggcttcctccacctcttcggcgaagaccagcacgcacacccggccgtcgcggcgggtcgcgctcgtggcgcggatgcccgcggcggacagcagccgccggatctcgtcggcgatctcgggctcgtcggtgaccgcggccggggacagcaggccgtaatcctcctgctcgccgaagatcgcgaggccgtccgcgtaaccgtccgcaccgacggtgggttgcaggcccatgcgccagaagacggcgccgagaaagccgaccagaccgacggcgatcagcgggccgatcagataccagccgtcgctcgtggccatgcgcacagtctggcaccgtcagggtgggatttccgggcctttgccccgatcgggaagcaccccttagtttccgttaagtaaccccgctacactgtcgccctctaacgaaggagtggagcatggcgggtcgtctcgcggtcatcgggtcgggattgatgggttccggcatcgcgcaggtctcggcgcaggccggttggcaggtcaccatgcgggacgtcgacgacgcctcgctcaagcgcgggctcggtgcgatccgcgattcgctcagccgcttcgcggccaagggccggatcgccgagggcgacgtcgaggccaccctgcagcggatcaccccgaccaccgatctggaggcggtcgccgaggccgacatcgtgatcgaggcgatcttcgagaaggtggaggcgaaacacgacgtcttcaagcagctcgacaagatctgcaaggcgggtgcggtgctcggcaccaacacctcggccatcccgatcacccagatcgccgcgatcacctcgcgccccgagtcggtggtcggcatccacttcttctccccggtcccgatgatgaagctcgtcgagctcgtccgcggctaccagacctcggacgcgaccgtcgccgcggcccgcgacttcgccgagggcgtcggcaagacctgcgtcgaggtcaagcgggacgtcgccggcttcgtctccaaccggctcttctcggccctgctggtcgaggcgatcaagctggtcgagtcgggggtggtctccgccgccgacctggacacggtgatgaagctgggcttcgggcacgcgatgggcccgctggccacggtcgacctgaccggtctcgacgtgatgctgaacgcggcgggcaacatctaccgcgacacgcaggacgagaagttcttcccgccggagctgctgcagcggatggtgaccgccggggatctcgggcgcaagaccggcaagggtttctacagctactgaccggtcgccatctcggcggtcgcttcctggaccgtcgcatctcccgccgaagccccgtggttgctaccgcggggcttcgccgcttggcggtacgccgtggccggcccgccgtgcgtcaccggtttcagtgggtggcgaaggagagcgacaggagggtggcggcgaccatgccgccgagcagggtgaggccgatgccgccgatgtccaggcgggcgtgcaggcgacggtgcgcgagcacggcggcggccggaaccccggcggacggggcgatcaggaaggtcagccacccgaggccacggatcagcagcccgccgaagacggcggtgtggccgaaagtgaccaggccggcggcgatcaggccggcgacggtcgaggcgatcgcgccgatcagcgggagcaggggcagcgaccagcggggcagtgggcggcggctcccggggcggaaacggtcgtcgatccggtcggcggcgcgggccagcagggcgcgcggcgactggcggccggggacgacgacgctgccgtcgatgtccggggagtcggccgagccggccgggcggcgttgcagggcgacccgggggagggcttcgatcggcgcgggttcggggacttcgccgagagcgcggacccgcatgccgcgggcgcgccggagctggtcccagagccgggccgcctcccggtcgacgtcgagcacctgggccgcggccgcgccggcccagcggtcggcggccagggcgtcgttctcggcgcgggacagttcgccggcggcccgcgccgcgctgtcctgataggcctgttcagcctggccgagttcggcgtcgcggcggcgggtcacctcggcgagggcgctcaccatcagctggtagtcgcgggtgggcggctgccggtcacgtgcggtcactggtcacctcataggggatgatcacttccggggtgcggtgcaccgatcggtcgaagaacagcgcccgcctcgggcgcgggtaccacgccgggccgcccggctgcgggtgcagcggggcgaggtcggcgccgtgcacgtcgagggcgacccaggcgccgatcgcgtcgaagcgggcgccgacgccgccgaggtcgtcgcggaggcgggggaccgaccgccaccagccgagggtgtgggtgcgccgctcggggccctcggccagcagagtccgcaggccgggctgccgggcggcgtccagcgcgaacccgatcacgtagtgcgggacgtcggtgaacgccaggtcgaagtggacgttgccggcgtcgtaccagtccgccgacggcaactcggtgtacaaccggttcgcggccgcctgcgccgacgggtcgaggcagatcacgctgaagtgggccgggccctgcgcggccaggctgagcgccgccgcggacagcacgtcgcaggcttcggtgacccgggtgccgagcaccgccaggttgcgtccgggcatccggcccagccgcagccgggcgggctgcgcggccacgtcgatccgctcgccgagcaccgcgcccggcgacgacccgatcggcgcgtccccggccggcatccggccggccgggcgcagcgacccgggcagccggggcaccgcgtccccgtcgaagatccgtggttcggcgcagccggccggccgttcccgccacagggtgcgctgcagggcgcgccagacgagacggtcaccggcgtccggcaggcggacgatccggttcgccccggacagcccggactcggtgttcaccaccgcgtggaagcgggggatgaccgcggcggccaggttgtcctcggccaggatccggcgcgccttgggcagcgcgatccgcagggtgaactgggcgatcagcccgggccgcccccacagcgcctggatcccggccacgtcctggctggccaggatcaggtggatgccctgcgagcggccccgccgggcgaggtcttcgagcaggtcgaccgcctcgtcggcgaccgcgtcccggccggccagcagcacctggaactcgtcgatcaccgcgacgatccgcggccagtgcccggccgggtcctcggcccgcagctcggacagtttgccggcatcgcagcgtttcgccgcctgcgcccgggtgcgcagttcctcacccaggtgccggagcatggccaggccgaactcccggtcgccgttgacgttgatcccggcgagccgcacctgcggcagccagctcgggtcgcgcgggccgggggcgtaccgggcgaacgacaccccttccttgaagtccagcaggtacagcgccagctcttcgggcccgtaccgggtggccagcgaacccagccaggtgtagatcaggttggtcttgccggacccggacggcccgccgatcagcgcgtgcggcgggtcgtcgccgagcggcacctcgaccagtgtcccgtcggtgctgtcgccgatcggggcgaccagcccgtgcaccgacgactcggtccagtgcttggccggctccaggtcggcgagccgggccgggccggcgccggcctgcagccgctcggcggtggtccggcagaaggccgcgatccggtcgggtgggggcggcgggtcgaggcggatctccaggctgccgagcgagccgcaggtggcgatctgctcccggaccacgatccgttcgatgctcggatcgtccgccagttccaggccgcggaccaccaggtgcacgccacaggcgacgccggtccgcacgatccggcccagttgagcccgctgcgccgtggtcatctccaccgaggtggcccggtcggcgagcagcaccaccagtttccacggctccaggcgcggcccgggccgggcggcgaccatgtcggccagcgtcgggtactgcccgccgagcgactcgtgcacccggcagatgtgctcggccaggtcgtcgaggagcgagccgagtccgcccggcccgacgaaggtcgggttgagcggcgcgaacggggccagggtgccgccgaggttttccgggtcgtagacggtcaggtgcacgtccccggcccgggtgctgcccagcgcccgcagcagcaccccggtgatcaggtcgtcgacctgcggggacggaccgctgacatgcaggtgcacggcgtccagcagcgggatcagcccgggcagggcggcggtctcctcgaaggtgatcgcgccgatccggagcaggccgggccggctgcccggatcgggttcgctgggtgaccacagccgccacggcgcaccggccgcgccggtggcgctggaggtggccaggccgcgcaggtgcccggcgagccgggtggcctcgccgcggaagcgtcgctcgatgtcgtcgcgggccgcctcgcgggcttcggcgagctggttgaggcaggtggcgtacgcgtcgcggaccagccgtcgccggccctgcgcctcgccgcgcgccgactcggcggcggccagcaccgcccgggccgtgccgcgtgcttcggcgagctcctggcggaccgcggcgaccagcgcgttgcggtgactacccacgcgaccccccggactccatgtggggggattttagcgattttccaccattacgacggattggacgctgcgtgtcgtgatctgtcgtcagaaagggcctcgctccacaggtggcccgcgacgatcatcgcggcctcccggtgccactgccgcatggtgtcctccggcacgttgcgccggaaccagtcgaccgccatccgggcctcccggctcagcccgtccagccgctgccgccgtgcgtacggatccagcccgagcaccccgcagaactgcagcgtgttgtagtaccgccagtcctcggtggtaccgaacgggccggtcggccgcagcgccgacaccgactcgcgcagcaccgcccgcaactcccgggcccgggcccgcggctggtcgtccccacgcccggcgatccgccgggccaccaccggcagaccggtcagcgggctgcgggacagccggttcagatcgttgaagtcggccagtgcccgccgggtcaaccggaggaactccggctcgcccagctcggccagggtccggcgctcccggcggcgcaacagcgcgtccgcgttcaggaacagcgcggcccggtcgtggcgcagccgcacgtccccggccagcgcgacccggtcgagcagccggctcatccgcccggtcagcccggccgcggccgcggcgaccccgaccggcacgaactgcaggcaggtcaccacggcgtcggcgggaacgacgtacaacgtcaatgtcgccggcaggccgaccagaaccaggacggcggccgcggcggccagcgaccggcgcaggtcgggccggagccgctcaccgccggtcaccgcgtgcgcgacagcgatcagatagccgaacaccagcaggtccaccccggaggcggcgagcgccggcaccgggccgccggcatcgagcgggaccagcagcgcggtcatcgccgccgcgtacagcagagccatcagggtcagggcgagcggcaggcgacgcggcaccacctgcgcccgcccgcgccacagcaggaacagcgcaccgcccagcggggtcagcccgaccagcttcccggcgcccggcaacgcgatcaccagcagctggaacgagacgccgaggaccagggcgccgacgtcgatcgggcgccgctcggccggcggcagcggcagcagcgcgaccacgctgccggcccaggccagggccggcaggcagatcaggatctgggcggtccgcccaccggggtcgacggtccaggcggcgaccccgacgccgtacgcggtcaggccggcgctcgcccagcgcagtgccggccgccccgggtcccggccgatcaggtaggcggcgagccaccagctgagggcgaacgcgggaacggcgaaggcgagcacccgcagagtcaaccaaacaggcgacgcgtttcgacacccgcgagccgcgcctgcttgcgccgcttccgtcgctggaacacccagaccgcggcccagaccagcaggaccaggcccaccaggaccagtaccggcaggagaatcgccagcaccgagagcagcacactggtgatgtcctcggcggtgctggccaccggggcaccgaaaccggccgtggtgacgttcaccaccggccgggacgccgccttcaccccgtgcacgcagaacgcgatcagcaccccggccgcgatcggcacccactggtgcgagccgaagaactgccccgggtcggtgacggtggccgtctccgacgacgagccggccccgaacgccaggccgcccgcggtcggccggaccagcgtctgcaccacgtcgttgaagtggtccaccaccggcaccttgtcggccaccacctcgatggcgagcaggatcgccaggatcacgatggtccagccgttctgcagccacgaccagccgtgcggaagatcgatcgcgtccgtgtagcgggccagcaggcccatactgagcagggggatgtatgcattgaggccggcggatgccgccagcccggtgccggtcaatgcttctaacacgatctcagcatggcaccggcacgctcgtcctgccggacggggcgggtcgggtagggtcgccgggtgcgtctggtcatcgcgaaatgctccgtggattacgtcggacggctctccgctcatctcccgctcgccacgcggctgctcatggtcaaggccgacggctcggtgtcgatccacgccgacgaccgcgcctacaagccgctgaactggatgagcccgccctgcaggctgcaggaggcgccgggtgtctggaaagtggtgaacaaggccggcgaggagctgcggatcaccctggaggaggtcttccaggactactcctacgagttgggtgtcgaccccggcctgcagaaggacggtgtcgaggcgcacctgcaggagctgctcgccgagcacccggaaaccttcggcgagggctacacgctggtccgccgcgagttcatgaccgcgatcggcccggtcgacctgctgctcaaggacgccggcaacgcctcggtcgcggtcgaggtgaaacgccgcggcgagatcgacggcgtcgaacagctcacccggtacctcgaactgatgaaccgggacccgctgctcgctccggtcaagggcgtcttcgcggcccaggagatcaagccgcaggcccgggtcctggccaccgaccgcggcatccgctgcgtcgtcgtggactacgacaagctgcgcggcatggaacgcgacgagctcaccctgttctgaccggtcactccagcgtgatcgcggccagcccggccgcgatccgctcggcggccttccggccggcgtactgcttgatcaggccttctttggcgaccccgcgcacccggaccaccgtctcgcaaccgcggtgctcgccggccccgccctccccgtgcgtgccgccgctttcggcgacgaccgccaccgtgacgacggccgggttcaggtccatcgccccggaaccgaccacggcccatagccggccggccggccgcccggcgcggtgcagcacggccccggcgatcctctccgcctcgtcgcggggcagcggcagggccacctcgacctcgtgcacgtcggccggcatgagccgcgccaccaggccggacagggggccgccgagtcgcctcaggccgtcggccagcagcgcgttctcttccggggtaaccgcatccaccacgacgccgatcctgacattgcgacgccggtgccgagggcccgggtccaccccgcgtaacccgtcggacccttgattcttcgcattacgctcggtgacgtgaagacgcgggtgacggtcgccgcggttgcgctgccgcttctcggcctggcctggctggccacgatggcgcggctggtcatcggcgccatcggcgaggggctggtggtgaatgcgaacgccggccaaggtgccgcggagacagcggccgcggagcgggccacggccgatttccggcgctgggcgaccatcgcggtgatcgagctcgccgccttcaccgtcgccgcgttcgtggcgcggatccgctgggtggggtgggtctcgctggccgtcaccgtcgccttcggcggcttcgccgggctgtccctgcgggacgacccggccggcccgcagccacggcccacgccgaccgtgtcgcagtgcatcgagcgcagcgggggcgacacccgatgccccgggggatgagtcagtcgcgcagcggcccgggaacctcgacgtcggcgaaggcggccaccgtgcgatcggcgtacgcgttcatgtcgccgctctccatcggcccgtcccacgtacgcggcaagggggttgtcgtcgtgccgggcgcgacgcgccggacgatctcgtccagcaccttttccgcgtcgccgacccacagatgtttggcaccgggcaccgggacgacctcggcctgcggtatcgcggcgaaacgctcggccgcggcgtccgggcgcaggtagtcgtcgaattccgggatgagcgcggtgaccggtttcccgtccgccgcccacgccgccaggtgggcgggctgcgagaagcgcagcggtggcgaaagcaggatcgcgccctgcaccgccgggtccaggccgtacatcagggtcagatcggtaccgaaggaccagccgagcagccagatgttcggcaggtcgtggaactccgcgaattcgatggcggcggccacgtcgtatctctcgtcggtggcggccgcgaaactgccgccactggtgccgcggacgctgccggtgccccgcgtgttgaagcggagcacggcgaggccggccagggcgggcaggcgccacgcggccttgcggaagacgtggctgtccatcatgccgccgtgggtgggcagcgggtgcaggcagacgagggtggcgaccggctcgcggtccagcgggacggccagctcaccgaccagggtgacgccgtccgcggtctgcaactcgatgtcctcccgcttggcgggcaggatggagttggcgcggatctggttgctcatgaccgccatcctcacccatagcggggagcgttgcgcgagcgctccacccccgggccgcgccggtcccgggcccgccagcaaccggtgtgccagtgccggcggtcgtcgccggcgccgtcgtgcggccaggcgacgatgtgcgcgacgccgggccggatgtcctgcaggcagccggggcacagataggtcttggtggcggccgcgccgaagatgttacgcaccatccagtccccgtcctgccactgctggacgcgctgctcggtgatgccggggcgttgcgacccggtgtcgggttcggcgtcgcggcggggacggttgcggcggggactcacgagttaagagtacgtagtgactcatcggtaacattgagcctagactcccggcatgacggcgactcacgttcccggcctgcccgtgatcgaggacggccaactgatctccaccaacccggcgaccggcgaggtggccggccgcgtgccggccgccgacgagaaggcggtggtggccgcggtcgagcgggcccgggcggccgccgcctggtggcagggcctcggctgggacggccgccggacccggctgctgcgctggcgcaccctgctcgtcgagcggatccaggaactggccgagctcacccggctggagagcggcaagccggtcaacgacggcatcatcgaggtgaccgcggccgtcgagcatctcgactgggcggcccggaacgcgaagcgggtcctcggcccgcgtcggatgcggacccggctgctgctcgccgagcacgtcggccacctggaataccagccgtacggcgtggtcggcgtgatcggcccgtggaactatccgatcgtcaccccgatcggcccgatctcgggggcgctggccgccggcaacgcggtcgtcttcaagccgagtgagtacacgccggtggtcggccagtggctggccgacacgttcgccgagatcgtgccggagcacccggtactgcaggccgtgcacgggctgggcgacgtcggcggggcactgtgccggtccggagtgggcaaggtgtcgttcaccgggtccacggccaccggcaagaaggtgatggccgcctgcgcggagaacctggtgccggtggtgatcgaggcgggcggcaaggacgcgctgatcgtcgacgaggatgccgatgtgcaggcggcggccgaggccgcggtctggggcgcgatgaccaacgccgggcagacctgcatcggcatcgagcgggtgtacgcggtcgccccggtctacgacgcgttcgtgagcgccgtggtggagaaggccggcagactgcgcaccggcgaggagatcggcccgatcaccatgccccgacagctggagatcatccgcgatcacatcgaggacgcgctggcccgtggtggccgggcggtgctcggcggggccgacgcggtgagcccgccgtacgtcgcccccacggtgctggtcgacgtcccggacgactcgaccgggatccgcgaggagaccttcgggccgacgctgaccatcaccagggtccgcgacgcggaggaagcgatcagcaaagccaacgacacggcgtacgggctgggtggctcggtcttcgggaagaagaacgcgatccgcatcgcccggcggctgcgctccggcatggtggcggtgaacggcacgctgaccttcgtcgggatgggcaacctgccgttcggcggcgtcggcgagtccgggttcggccggatccacggcgaggacgggctgcgcgagttcgcccggccgaaggcgatcaccgtgcgccgggcgcggtcgctgctgcccgcgatgaccttcgagcggaccccggcgcaggtgcagcagatcgtcaaggccctgcgcctgctgtacggacggaaaccgtagtctgtccgggtgaccgaccaccccgcggttgaggtaagcgatctcacggtgagttatggcgcgaccccggtgctggacggggtcgcgctcaccgttccggccggcaccgccgtctgcgtcaccggggagaacggcatcggcaagtccaccctgctgcgctgcgtcagcggcctgcaacgggcggacgccggccggatccgggtgttcggcgcgacgcccggctccagccccgagttctgggccgcggtggtcaccaccgtcgagccgcccacctggtatccggggctcaccacgcgcgagcacgtcgagctggtctgccgcgcccacggccaggatccggacgaggccggcgtcgacgaggcgctggagcggttcgggctggccgggcacgccgacgcgatcccgccgtcgctgtcctccgggcagaagcagcggctcaccctggcgatcgcgctgatccggccgagctcgctgctgatcctggacgagccggagcagcgcctcgacccggacggccgggcgatggtcgccgcgatgctggtggactatctcgccaccggcggttcgctgctgatggccagccacgacgacaagttcgcggtcgcctccggggccgagctgaccacgatggagtcgctgaccccatgacgatcatggtcgagttgggcccggtccgccgctggatccaccagcgccaggtctcccatcgggagcgcggggcgacgctgggcaacctgtacgtcgccgcgctggtcgtcgcggtcttcggcgcgatgacacaccggcagctcaccaggggtttctggccggcccacccggatctcggggcgctgcccgcactcgctctcgggctgctcggcatcggcttcctgaccatgacgctgcgcgcgatcggtccggtcacgctcggccgccccgcggcgtacttcctgctcaccgcaccggtcagccgccgccggctgctgctgccgtcgttgcggttcgccgcgctcggcgcggccttcgccggcgcgctgatcaccttcgcgatcaccgggcacgccgcgccgcacgaccgggtgcccgcactgatcctcggcggcgcgctgatcggcatcggtctgctgctggtcgcggtggtcgcgcaacgggtgcgccgctgggccacgctcaccgaccggctcgccgtgctcaccgtggccaccggcgtcgcgctgctggtcatcgaccgggtcaccgctgccgatcggcccgcctccggcggatggccatcggcgccggcgctgctcgcggtcgcgggtgccctcacggtcgcggtcacggccgggttcctcgtgacggtacgtctgctgccccgcactccggacgaccggatcctggaagcctcgaaggtgaccggaaccctgttcgacacggccttcgggatggagccgtcgttcgtcaccgagatggtcgcgcggcgctactgggcgaaccgccggctgcgcaccacccgcccgccggcccgccttccggtgctgaccggccaggacttcctgctggcccgccgccgcctgccccggctgctgtggctgctcgccgccaccccgatcccgctgctgctgaccgccgccccaccctgggtcgccgccctcgccctgctgctcggcgcgatgatcgccggtggcaccacgaccgccacggtgaacaccgacgccggcaacccggtgctgctccggctgttgagcctgagctcccggcaggcgctgacccagcgtctctgggtccccggggtgctggcgttcgcctggtcgctgatcgcgctgatcctgatggagaccaccgggcatctgccggccggacggtggtggctgctcagtgtcccggccggggtgatcggcggggtcgccgcggtccgccgggcccgcgccggattcgtccgcaacgacctgctgccgctggacacgccgatgggcacggtctccaccggcccggtggtctacgcggtcgccggccccgacgccctgatcctgggcatcccgatcgtgatcgccttcggccggggcaccccgctgagcctcgacctgctgctgatccagaccgctctggccctgctgggcgcccgcgcctacctggccggcacgaccgactcggcccgggtggacctgcagccctgatccggctcgcacggcgccgcggccggagcggtcgccgcacttcggcggtcaccaccactcactgctcgggccggaacttcttgcgcagcaggtccagctgcgcgcggtcggtgatccattcccggaccaggccgcactgcaggcagatcacccgggagaacgggatcgtccggaaggcgctgaccgtcatgccgctgcggttgtagccgtcgttcatgctgctcggcacgcagatgatctcagcgctcccgcagtgcgggcacgtgaaggtggtggcatccatggcttgatgatcacagtcgttcgccggcggtggctctccgtcctcgcctcgcaccggcccacgccgtacgacggggcggtgacctcgacgccggaaaccgggccggagcgccgagtgggtggatccggggtgagcggccggagaacagatcacgggtgcggcagcatgggggaatgaagcgccgctggcttttcgccgatcagttggggccgcattttctggacgagccggggcagccggctctgctgatcgaatcgaaggcggtgttccggcgccgcgcctttcaccggcagaaggctcatctggtgctgtcggcgctgcgccaccgggcgagggagggtgacgcgcggctggtgcgcgccgagacgtaccgggaaggggtcggcgaaccggtcagcgtgtgccatccgacctcacgggcggcccgcggtctggtccggcgactgccggatgtcgagatgctcgggccgcgcgggttcgtcacctcgccggaggacttcctcgcctgggccggtgggcgggagcacctgcggctggaggacttctaccggtatgcgcgccgccggcatgacgtgctgatggacggtgccgagccggtgggcgggcggtggaatctcgacgccgacaaccgggagccaccgccgcggggggccgggcggctggacgtgccggtgccacccgtgatccgcgaggacgagatcgacgaggaggtgcgcgccgacctggaccgctgggagcgggaggacgggatcaccttcgtcgggcacgacgggccgcggatgttcccggcgacgcgggccgaggcgctggagcggctgcggcacttcgtcgagcatcggctgccgtcgttcgggccgcacgaggacgcgatgctggccggtgacccgctgatggcgcacagcatgctcagcccggcgatcaacctggggctgctggatccgctggaggtcgtcgagtgcgccgaggacgcgtaccggcaaggggctgcgccgctggccagcgtggagggtttcgtccggcagattctcgggtggcgggacttcatctggcacctgtactggtatttcgagccgcagtaccgggccgtgaacgaactgcgggcgcgtcgcgagctgccggaatggttcgctcgcctggacgccgacgcggtgcaggcgcgctgcctgtccgacgtgctggccggggtgcgcgaccgcggttgggtgcatcacatcccgcggctgatggtgctgggcaactacgcgatgcagcgcggctggcggcccggggcggtggccgactggttccaccggtgcttcgtcgacggctacgagtgggtgatgacggccaacgtgatcgggatgagccagttcgccgacgccggacggatgagcagcaagccgtacgccgcgggcggcgcctacctgaaccggatgagcgactactgccgcggctgccggtacgacccgaaggtgcgcgtgggtgagcaggcctgcccctacacggccggctactggggtttcctcgcccgcaacgaggaggcgctgaccggcaaccaccgattggcccagccactgcgtctgctgcaccggctgaccgacctggacaccctggtcgagcaggaggagcaacgcggctcccgggcgccgtagtcgcgaccgacgccacggtgaccaggcactcggcccgccgtgaagaggagaccgggtgccggacgggccggccgcgcggctccggggcctcatcgggctccggagcgacggcttcgggcgcggcttcggtcgacatgggaccggacggtatcgcccgggcgcaagcgttcgccggccggttctactccgcgtcggcgggcacccggctcgcctgcggaacggtcaccttggcggacgcggacaccttttccgacgacttgtccaccggagccgacccggaagcaaccggagccgacccggcggcgacgggggcggacccggaagcaacgggggcggagccggaagcaacaggggcggacccggaagcgacgggggcggagccgacggcggccgactcctgatcgtcgggggaggcggcggccgccagcaccgcggcggcggccagctcggccacccgcttcgcctccatctgcacctgccggcggacgtccgcggcatgccgctcagcggcctccccggcccgcttggcgtcggccacccgctgcagctcggactccagttcccgggccgcctcggcctggcgctgccggacccgctcggtctcctgctcggcggcctccgcctgctcccgggcggcggccagccggcgttcggtctcggtgacctcggcctgggcggcctccagctcccggccggcctgggcgatcttctcctggtgcgcggccagctccttgcgggtggcggtggcctgctcgtcggagcggcgcagcacctcctccgcgtacttgtcggcctcgctgcgcaggtcggcgcactgcttctcgacgccggagcgcatctggccgagctcctcgatcaccgcgtgccggcgcagcgccagctcgtgctcgacggcggccttgaggtcggcctgctcccgctcggcctcggtgcgccgggcggtgatctcctggttcgtcttctcccgcagggctttgagctcctgctcggtctgcacccgggtcgactgcacgtagccgtccacctcggcgcgcagccgctgtgcctcggcggccgccttgtcggccaggtgctgcgcctccgcccgcgcgcgggccagcagggcctcgctctcggtgcggatctgctcggcggtctgccgggcggtggcgaccgccttgtcggcggcggcccgcttggcggcgtccgccttctcctcctcggcccggcgggcggccagcgcgatctcgaagtcgcggatgccgtcgtgggcatgcgcctcggcctcggcccggatccgttcggcctcggcgagccggccggcgatgtcgtcggtggccgacgccttgatcgcctcggcctgctcctcggcgaggaccaggatctgctcgacccgggggccgagatgccggaaggagacctcaccggacatcccggagttgcgccgggcctgggtgatctcctgctgcagccgctcgatctgggccgccatcgcctggatctgcgaatacgcctgctcccgctcggcggcgagcgcggcgatctcgttctcggcacgggcgacgtagcgttcgacctgcttccgttcgtaaccgcggatcgcgaactcgaagctgggctcggtggccgagtctccgttcaggccgaagatttcaccgccgtgcgacatgctttccatcctcacatacgcgtagtcccggggcgtgtggttacacaccggcttgcgggggactacgcgggtagttacgaattgtccgaccgggcgccgggcggaacacaggctacgcgccaaaacgagtcaggccgccccggagaaactccggtacggcctgagtcacacaaagccgacccgaacaaccgtcgcgcacccgggaggagagcgcaaccgcaggggtcaggagttggtcttggcgggctccgcctcggcctcctcggccggctcggccggttccgcctcggcggccggctcggcggccttctgaacggcggcggcgaccgcggccggggccgcacccacgccgggaaccaggccggacagaccggacagcatctggcccagctggttggtgaccgcgtccttctgccgggtcaggtcctcgacctcgcggcgggccgcctgggtggtcagctcggcctcggtgcgggcctcgctgagcaggcgggtggactcggaacgggcctcggagacggtcttgtcggcgagggcgcgggccttctccaccgcctcggcggcggtgcgctcactctcgatgcggcggctctcggcgcgctgctcgatctccttggcgcggtcctcggcggcgcgggcccgctcctcggcctcggacaccatcttctgcgtggcggcgacctgggcggcgtgccgctgcgactcctcggactcggccttctcccggcgctcggcgatctccagcgccagggcctgcaggtccttgtcgcgcttgtcgcgggcgtcggcgagcatcttggtggcctcggcgcgtttctcctcggcctcccggccggccttggcccgggcctgggtgatctcccgctcggcggtggcgcgcagcgaggagacctcgcgctcgaccgtcgacttgagctcggccacctcgtgcgcggtgaccgtgcgcagctgcttggtctcccggtcggcgtcggagcgcagcgtgtcggcctcgcgacgggcctgcacccgggtctcggcggcctcgcgctcggcgtgcgtgcggacctggccggcctcacgctcggcggtcgccttcatcgcggcggcctcggcgcgggccttgtcggtgatctcccgggcctcgaggcgcgcggcggagaggatgccctcactctcccgcttggcctcgccgcggtggtcgttggcctgctcctcggcgagccggagaatctgctcgacccgggtgcccagcccggagagcgtcggccggttgttctcctccagcagtttgttgctgtcggcgagtttctgctccagcacgttgagccgctgctcggcctggcggagccggcgctgggcgtcgttcatccgctgttcggcctcaccgcgggcctgctcggactggttcagcgcggcgagcagccggccgatgtgtccgtcgacctggtgacggtcgtaaccacgcaggacgaccgtgaagtcgtgctgggtgttcgcggtctcgaagaaggccaggttctgatcctgctgctggggcattgcgccatcctggcgagaagggggccgagttgcaagggcggggtgactctcagaccccaatgtagatcagctttgacctggaacgcagacgggtgccgggccgttcgggggacgaccgtcactcacccggcccgtccggcgtggtcccgtcgctacctgctgagtcggggcttcgggggcgcagcgtcccgctgaggggtcggtcggccctgctcaatggcaccgatcctgccagccggccggtccgccgtcaggctgaatcacccggtcggcgtaccggcccggccggctcgaccagctcgaccagcaccccgccggcgtccttggggtgcacgaagttgatcctcgatccggccgtgccgcgtttcggggtgtcgtagagcagccgcatgccgcgggcccgcagagcgtccgcggcggcctccacgtcggccaccgtgtaggcgagttgttgcaggccggggccgctgcggtcgaggaacttggcgatcgccgagtcgggccgggccggggcgagcagctggatccgcgggcccgcgccgtcgccgacggcgagcatcgcctcccggacaccctgttcgtcattggtctcttgatgcacacaccgcaaaccgaacttttccccatagaagcggatggcctcgtccaggtcgggcaccgcgatgccgacatggtcgatccggaggaggccgatccccggcaggtcgtcgccggcgagtgtgagattctcgcgccgaccggtactcgatgtgtcgtcagtcatgccattagtctcggacctgactcttcgttaagccggccggggtgtccaccgcacccggccgccgcagatcggacgtgacccgtgaccagctctgtgatcgtcagtggcgcccgcaccccgatggggcggctgctgggcaacctcaagcacctccccgccaccgcgctgggtgcgcacgccatcgccgccgccctggcccgcggcggcgtcgcccccgaccaggtgcagtacgtcatcatgggccaggtgctgcaggccggcgccggccagatcccggcccgccaggcggccgtcgcggccggcatcccgatgtccaccccggcgctcaccatcaacaaggtctgcctctccgggctcgacgcgatcgcgctggccgaccagctgatccgggccggcgagtgcgagatcgtggtggccggtggcatggagtcgatgaccaacgcgccgcacctgctgatggaccagcgcaaggggaccaagttcggcgacaccacggtccgtgaccacatggcgctcgacggcctgaccgacccgtgggccggggtgtcgatgggcgagtccaccgaggtggccggcggcacgctgaacatcagccgggccgagcaggacgcgttcgccgcgctcagccaccagcgggcggccgccgcgcagcgcgagggccggttcgccgaggagatcgagccgctgccctccggtgaccgtcgggcgcccggcccgatcgacaccgacgagggggtgcgcccggacaccaccgccgagggcctggccaagctgcgcccggcgttccggccggacggcacgatcaccgcggccacctcgtcgccgatctccgacggcgccgccgcggtcgtggtgatgagccgggccaaggccgaggagctgggcctgacctggctcgccgagatcaccgcgcacggcaacgtggccggcccggacagctcgctgcagtcgcagccggccaacgcgatcaagcacgcgctgggcaaggcgaacctgaccgtcgaggacctcgacctgatcgagatcaacgaggccttcgcgcaggtggcgatccagtcgatgcgcgagctgaaggtcgacgagagcaaggtcaacgtcaacggcggggcgatcgctctcggtcacccgatcgggatgtccggcgcccgcctggtcctcaccctggcgctggagctcaagcgccgcggcggcggcaccggtgcggcgtcgctgtgcggcggcggtggccagggcgacgcgctgatcatcaaggttcctgcatgagccgtacgcgtgatgtgccctccctggtcgccaaggcccgggagggcgatccgcggtcggtcgcccggctgatcagcctggtggagaacggcgacccggcactgccccaggtcgccgccgcgatggcgccctacgccggccgtgcccaggtggtcgggctcaccggcgcccccggcgtgggcaagtcgaccaccaccaacgagctggtccgcgccctgcgcgcggccggtcgccgggtgggtgtgctggccgtggacccgtccagcccgttcaccgggggtgcgatcctcggcgaccgggtgcgcatgcaggagcacaccgcggaccggggcgtgtacatccgctcgatgtccagtcgcggtcagctcggcggactctccgcggccaccccgcaggccgtccgggtcctggagggagccggctgcgacgtggtgctggtcgagacggtcggggtgggtcaggccgaggtggagatcgcctcgctggccgacaccacgctggtgctgctcgccccggggatgggcgacgcgatccaggcggtcaaggccggggtgctggagatcgccgacgtcttcgtgatcaacaaggcggaccggccgggtgcggacaacacgtaccgcgacatccaggggatgctggcgctcggcgagcggacggccggtgactggcggccgcaggtggtccgcgcggtcgcggtcaagggcgagggtgtcgacgacgtggtcgccgcgatcgagaagcatcgcgcctggatgaccgagagcggcgagttgcgggcccgccaggagcgccgggcggcggctgaggtcgcggcgctggcgctgggcacgctgcgcgcccggatcggcgatctgcgcgacggcaccgcgctgcccgcgctggccgccagggtggcggacggcgccatcgacccgtacgcggccgccgacgaactcctgagcggcctctaggaaccgaactgggccatggtcgcctggatcatggtccagtcccaggtcagcgtgccgttctccaggtcacgcaccaccgcgcgcagccagtccagctcggcgcgcagcagggcggaccggtattcgtcctccagcaggaacaggcgcggcagcccgggcggtgcctgggcgtcgattcccgcggcccgctcggtgagcgcctcgatccggcggtgcagcagctcccgggtctccgccgggctcagcatggcgaggaacgccagggccaccgggaactccgggaactcccgggccggcgccggcagcatctccagcagccagcggcgcagcatggcgcgtccctcgtcggtgatctcgtagaccgtccgctccggccgcccggcctcgcggacggtctccccggcgcgcgccaggttctcccggaccagccggtcgagagcctggtagacgctgttgcgctgggcgacgttgacgagctggtcctgcccgcgctccttgatcacctgctgcatccggtacgggtgcatcggcgcctccgacagcagcgccagcagcagcatcgcggtgggggagcgtttcatgccgatcaccctacggtcccctggagcggcatagtcattttatgtatagtcattacatgactaaaaatgctgccgtgatcggcgggggcgtggccggcaccgccgcggccatcgccctgcacagcgccgggttcgacccggtcctctacgaacgcaccgcgcaaggcgtggccgacgagcgcggcgcgttcctcaccgtcgcgatcaacgggctcaccgcgctggccgcgctcggcctcgacccggcgaaagtgctggacaagggcttccccacgccggccatggagctgctcggcgcgtccgggcggccgctcgccaggatgtcgctgggcgagggcacgctcaccatccggcgctccgacctctccgcgcggctgcgggccgaggcccaggccaggggcatcccggtgatccacggcgcggcactgacccgggcggtcaccggtgcggaccgggtcgaggcggagttcgccgacggtcgccgggtcacggcggagcttctggtgggagcggatgggctgcgttcgcgtacgcggcaatcgcttgatccttccgcgccggaaccgcactatctcgggctgctgaacgccgggggtttcaccgccggcccggtcgatccgcgtctggcgccgccgcccggcctgatgcggatggccttcggccggcgggcgttcttcggctgggcgaccgcgcccgacggctcggtctggtggttcgccaacccgcccagcaagcggccgatcgacgccaccgccgtcacgccggcatcgtggcgggcgcatctgctggacctcttcgacggcgacccgtcgtcaccggccgccgagctgatccgggccagcgacgagatcgtcggaccgtggaacaccgaggacatgggcccgatccggacctggcacgacgaccggatcgtgctggtcggcgacgcggcgcacgccctcgcgccgacctccgggcagggcgcctcgcaggccctcgaggacgccgtcgtgctggggcacgcgctgcggagcaaccccacgatcaccaccggattgcgggcgtacgagagcagccgccgtccccgggtggcgaaggtcgccgcgcacggccgccgcggcaacagcaacaaggtgatggggccggtcggggcggccatccgggacgcgatgctgcccacgatcttccgcctgctcaaccggaagggcgacccgcaggcgtggatcttcgagcaccggctgccgccgttgccggtcaggccttagtaatcgttcagttctggctctaggatggctcgcatggacgcagccgagatccaggccgggcgcgagcgctggcagcgccgctacgacgcggcccgcaaacgcgacgccgacttcaccacgctctccgggaaccaggtggacccggtctacggcccgccggccggagccacccaccccggcttcgaacggatcggctggccgggcgagttcccgtacacgcgcggcctctatccgaccggctaccgcgggcggacctggaccatccggcagttcgccggcttcggcaacgcgcagcagaccaacgagcggtacaagatgatcctggccgccggcggcggcgggctcagcgtggcgttcgacatgccgaccctgatgggccgcgactccgacgacgcgcactcgctcggcgaggtcggccactgcggggtggcgatcgactcggcggccgacatggacgtgctcttcgacggcatcccgctgcaggacgtcaccaccagcatgacgatctccggcccggccgtcccgatcttcgtgatgtacctggtggccgccgagcggcagggcgccgacctgagcaaactcgacggcaccctgcagaccgacatcttcaaggagtacatcgcgcagaaggagtggctcttcgcccccgagccgcacctgcgactgatcggcgacctgatggagtactgcgcggccgagatccccaagtacaagccgctgtcggtcagcggctaccacatccgggaggccggggcgaccgccgcgcaggagctcgcctacaccctggccgacgggttcggctacgtcgaactcggcctgtcccgcgggctcgacgtcaaccagttcgcgcccgggctcagcttcttcttcgactcgcacctcgacttcttcgaggagatcgcgaaattccgcgccgcccgccggatctgggcccggcacctgcgcgacgaatacggcgccaccagcgagaaagcactgtggctcaaattccacacgcagaccgccggggtgtcgctgaccgcccagcagccggtcaacaacgtggtccggaccgcggtggaggcgctcgccgcggtcctcggcggcaccaactcgctgcacaccaacgccctcgacgagacgctggccctgcccaccgacgaatccgccgagatcgccctgcgcacccagcaggtgctgatggaggagaccggggtggtcaacgtggccgacccgctcggcggatcgtggtacgtggaggcgctcaccgaccggatcgaggccgaagccgaggagatcttccaacggatccgcgacctcggacacgacggcagcgtgacggcgggcattctgcgcggcatcgaggacggctggttcacggcgcacatcgccgaggcggccttcgcgtaccagcaggccttggagaagaacgacaagcggatcgtcggggtcaacgtgcacaccggcaccgtcgccaaggagctggagattctgcgggtgtcccacgaggtcgaggtggaacagcggcgggtgctcggcgaccgcagacgccagcgggacgcggcgcgggtcaaggccgcgttggacgagctggtggcggtgtcccggaccgagcagaacatgatcccggcgatgctggaggcggcccgggccgaggccaccctcggcgagatctgtgacgccctgcgggacgagtggggtgtctaccgggagccggcccgcttctaacattcacggctttttcccggcggtccgtgggttgctctgtgacgtccgatatcgcccgcccggcggcggcgcgaacaggccggacagcgtgcgagactaggtaaccatgagcgacccacggaccactccgtcgatcttcacccgcggcgcggtcgatctcagcgcgctgcgtaccccggcgccggccaagccggccgcgccgagccgatccgccgccgccgacggcgcaccggccggcggcgtgccgggcaccctgccgggcctcgccccggaaacgatcgtcgacgtcaccgaggccaacttccagagcaccgtgctggagcggtcgctcaccgtcccggtcgtcctcgacttctgggccgactggtgcgggccctgcaaacagctctccccggtgctggagaaactcgccgtcgagggccagggcgcgtgggtgctcggcaaggtcgatgtggacgccaacccgcggctcgcccaggcgttccgggtgcagggcatcccgatggtgctcgccgtcatccagggacagcccgtcgaaggcttcaccggggtgctccccgagatccaggtcaagcagtacatcgacgcggtgctcaaggccgccggggtcagcaccggcgcggccgcgccggaggacccgcggctggacgccgccgacgacgcgctgatggtcggtgacctcgacgccgccgaggcggcgtaccggaagattctcgccgagtcacccgccgacgcggccgccgaggcgggcctggcgcaggtcgagctctaccgccggatcggcggcgccgacgccgaatcggcgctggcccgggccgcggccgcccccgacgacatcgaggcgcagcggctcgccgccgacatcgaggtgctcagcgggcaggccgacgaggcatacgcgcggctcgtggctctcgtcaagaagaccagcggagaggatcgtgacgtggtgcgcaagcatctgctgtcgctgttcgccgtcgccgggccggacgacccggcggtggcgggcgcgcggcgggcactggccagcgcgctgttctagccaccgtcagacgacacaagcgggggagggcgtcgtgcgacgcatcgccgttctggacgcgccgtccaatctcggcctgcgcccgccgacgcccacatcggtgccgggctgcgccaaggcgcccggcgccctccgcgaccaggggctgctgccccggctcggcgcccgcgacgccggctgcctcaccccgccccgatacgacccgggtgactggcgtcccggcgacggcgtcgcgcacgccgccgaaatcgcggcatactcgcgcgccctcgccgaccggatcggcgccatcatcgacggcggcgagttcccggtcgtgctcggcggcgactgctccatcctgatcggctccgggctggccatgcaccggctcggggaagccgtcggcggccggatcggcctcgtcttcgtggacggtcactccgacttccggcaccccggcaacgcgtcctacgtgggcgccgccgccggcgaggacctcgccctggtcaccggccgcggccaggccaacctggcggcgatcgagagccgccgcccctacttccgcgacatcgacgtggtcgtcctcggcatccgcgcccaggacgaatatcgcctcgacctgcaagccgccggcatcgtcacccgcccggtcccgatgctgcgcgccgagggcgccgcccgcagcgcgcagtgggcccgcgaccagctcgtggactgcgcgggctactgggtgcacgtcgacgtcgacgtgctcgacccggcggtgatgccggcggtcgacgcaccggacccgggcgggatcgccttccccgaactcgaactgctactgaccgggctcgtcgaatcaccgcactgcctcggcgtggagatcaccgtcttcgacccggactacgacccggacggccgctacgccgcggagatcacctcagcggtggtgagcggcctggcgccggtccgcacggtgacgccgcggcccgacctgatcgccgcccgcaaggacctggccaaccagcccgccgcggcgccggccgcgcggaatgagtcggcccctgccgtcgggtcggctgtgggggctggggtccgggcggagtcggcctctcccgctgaggacgccgccgtcgtgggggctcccgcgtttgccgaggccgtcgaatctgctcccgccgcggagcttggcccggcttctgggcgtgccgcgcttgcggagcccgccgggcttgccgcgcttgcggagcccgccgggcttgccgcgcttgcggagcccgccggggctgccgaggcggaggcgtcggttatcgcgccgtcggtggctgagcgggcctccgatggctttttagccgaaatttcggacagtggtgcggagaccggtgcggagcctgagcgggcgggaacccccgctgaggaccccatcgatcgcgacccagccgaatcgaccggcgaggagctgtccgacggcgacccggccgcgccggttggtggtgggctgtccgacggcgacccggccgggccggttggtggtgggctgtccgacggcgacccggccgggccggttggtggtgggctgtccgatgaggagccggctgcatcggtagatgttgggatgtccagcgacgatgcggtcgcgccggttggtgggccttccggtgacgatgcggcgataccggttggcgaggagctgcccggcgaggagccggcagatgcgatcggcgagacgctgtccgacgaggagttgagcgagccgggagctgcgtccgagtccgagtccgagtccgagtctgagcttgaaaacgataaggacggcccggtttcggtcgttcccgcggccgaaaaaccggtgcgacccgagatcccgctgctctcccggccgctgggctcggcgccgctgctcgactcggagccgctgccggccaccaggcctggcatgctgcgcccccgcacccctgccgacccgcccgctgtcggcgccgccgccgtgccgcggccgggcttcggcccagcgatcccgccggtctactgacgagcgagccccgtcaccggcggggctcgcctgttccggcgggcttgaggtgggcggtggtgagtgggccgtcccgggtggggcctgtcttcgtatggtggtgagcgagccgcaccggtggtggtaagcgagccgcaccggtggtggtgagcaagccgcccgggtagtggtgagcgggccgcaccggtgggcgggcaagccgcaccgggtggtggtgggcttgccgcccgggtagtggtgggcaagccgcatcggtgggtgagcgagccgcaccggtcggtgggcaagccgcaccggtggtggtgggcttgccgcaccggtggtggtgggcttgccgttcgcgggggtcacttcgtcagagtggtcaggaactggttgacgatggggacggcggcttcggcgccggcgccgcctttctgcaccatgacggcgaaggcgatgtcgtcctggtagccgatgaaccatgagtgggtctcgtcggagccggtggcgaattcggcggtgccggtcttgccgtagaccggcttgccggggacggctttgagggcggtgccggtcccgccggtgacgacctcgcgcatcatcgagcgcagcgcgggcagcgcggccgggttcagggcggcgggggcgggcgcggccggcggggccgggtcgaggaccagtttgggggcctggaagccgcccttggccaccgcggcggtggcgaccgccatcgcgatcgggctgaccgcggtggtgccctggccgaacgtggcggcggccagctcggtcgggctggccccgtcggacaccttgccggtgaacgcgtcgacgccgatggtccagccgccgccgaggccgagcgcggcggcggcctgcttcagcccgtcggcgcccagctggctggacaggccgacgaacgcggtgttgcaggacttcgcgaagtcgacgtggaacggcaccttgccgagcgcctcgtcgtgcgagttcttgaacgtctgcccgtcgacgacccgggtcctggggcattcgacgaccgtgtcggcggtgaccttcccggtgctgagcaacccgtacgccgagatcatcttgaaggtcgagccgggcggcacctggccggtcagcgcggtgtcgaccccgccggcgtccggcccgttggcgacggcgagcaccgagccgtcgctgatccgcagcgccaccatcgagctgggcagtttctgcgcgccgatcgcccggtcggccgcgttctgggtggcggtgtccaggctgaccctgatgtccttgccgttcaccggcggggccgtgaagatcggcttctcctggaccgacgcgtcggccgcctcggcggaggccaccacggacaggccgggggtgccgcgcagctgctggtcgtaccggccctgcaggccgccgtgcccgacctggtcgccggcggtcaactcgctcggccggttgtccaggtcgtccttggtggccgggtcgaccgtgccgagcagggcgcgggcgaacacccgggtgggtgccagctgccgggtctcctcccggaacacggtgccgggcaggggccgcacctgatcgcggatcgtgtcgtagtcgggccggcgcagggtgaccaggtcgaggaaggcgccggggtcggccttggcgacccggtccttgaggccggccagatcgacgtcgaccttgatcttcttgaacgcggcggtgagcgccttggtcagcgccggcagattcgtgatcttctccgggctgaccccgatgaccaccaccttctgcgggccgaccaggggcttgccggcggcgtccaggacggtgccgcgctgggcgggcacccggtgcagccggaatttctcgccctggtcgagctggggctgcagcacggccggctcccagatcacctgccagccgtcgccgctgcgcctggtcatccggacgctggacctgtactcccagatgacgttgccgggcagagtccacttcaggtcgatcggcgtggtggcgacgtcgccggactcggtcgggtcgccggccaccgagacggccaggggctggtccttgaggtcgccgtaggtgctcttgatcgcggcgagcacgtcggccgaggcgatctttccgccgccggccgtgacgaagcccaccttgccgaggtcgccgttcttccagccgttgacgaagtccaccacggtgtcctgtggcttgtcgcccgaacaccccgctaagccggcggtggccagcgtgaacagggcagtcaatccgacagtggcgcggcgcatgaggtttccccccgtgggtacgtcttgctgggctgctcgcacggtagtcctcgaaggcccgccgcgccgccccgcatcgggcgaaagctcgcatacctgcccacctgtcgggctggcacacccggggtgtgaagctgtcgcgccccgtcgttctaggctgtgcccgacacgttcgaacccacagtgccgtgggtgaggggagcgccggaccatgcctgtcgccgacgaggcagcgaccgattctgatcagaaagattccagggggccagggcctgatcttccagcgcccggtcccgggctggccctgaccggccggctcggagcctccaccgaccagggagagctcgacgagccgctcccgaatgccgagcgcctggtcgcccaggccgtggagcgagccggcgacgaccacgccaccgcgttgctggtcgaccgcttctggcggttcgcacccgacgaggagctggtcgggtacaccccggaggagatgttcaccgccgcggtcgagcaccgcgagctggcccgcaaccgtctccccggcgagctgaagctggatctcaccgagccgcgcggcgcccagtcgcacaccgtgctgcaggtcgtcaccgacgacatgccgttcctggtcgactcggtgatcgccctgctcaccgcgcacaacctgcaggtccacctgatggtgcacccgctgatcgtggtgcgccgcgagccgctcggcgcgctcagcgagctggaggcggacgtcgagccggacgacgccatcgagggcgacatcgtggagagctggatccggatcgagatcgacccggtccgtcgcggcgaggcccgcgaccaactgctcaacgaggtccgccgggtgctcaccgacgtgcgcgaggcggtcgaggactggccgcggatgcgccaacgggccctggtgatctccgacgagctggccaccgcccgcggctcggaccgtcggctgccggtcccggagaaggacgtcaccgactcgatcgagctgctcaagtggctcgccaacgaccacttcaccttcctgggctaccgcgagtaccggctggacgacggggtcctgaccgcggtgcacggcagcggcctggggatcctgcgcggcgagagccgcccgcgccggctggacacgatggcgcccgaggcgtacgagcgggccatggagaagcgcctgctggtgatcaccaaggcgaactcccgggccaccgtgcaccgttcggcgtacctggactacatcagcgtcaaggtcttcgacaccgccggcgaggtggtcggcgagaagcggttcctcggcctgttctccagctcggcgtaccggaccagtgtccgggagttgccggtggtcaagcgcaaggtgaccgaggtgatggaccgctccggcctgtcgccgcgcggccactcgggcaaggacctgctgcagatcctggagacgtatccgcgggacgagctcttccagatcaagaccgatgacctgtacgaggcggtcatcggcgtgctgcggatggccggccgccgtcagctgcgcctgttcctgcgccgggacgggtacggccggttcatctcgtgcctgatctacctcccccgggaccggttcaccaccggcaaccggctgcgcatgcaggagatcctgctgcgcgagctgaacggcgtcggggtcgactacaccacccgggtgaccgagcggatgctggcccgggtgcacttcatcgtgcgcaccgacccggccgcgccgcccggcaacctcgacccgaacgtgctggccgagcagctcgccgacgccacccggatgtgggacgacgacttctccctggtgctggagcgcaagctcggtgacgagccggccaaggagctgttcaaccggtacgcgcacgcctacccggagagttacaagaacggccacacgccgtacgagggcatgcaggacctggccaagctggagctgctggaggagccgggccagctggagatgcacctgtaccgccggcgccggctgggggccgacgggtcgcccgagccggacgaccacgacatccggttcaaggtgtaccggttcggtgagccgatgatgctctccgccgtgctgcccgtgctgcactcgctgggcgtgcaggtcagcgacgagcggccgtacgagatccgccgcgacgacggactggtctacctgtacgacttcgggctgacgccgcctaaggtgcaccgggacctgtccgaggtgcgcccgcaggtggagaacgcgttcgcggccacctggcggggcgaggccgaggtcgacggcttcaacgagctggtgctgcgcgccgggctcacctggcgccaggtggtggtgctccgggcgtacgcgaagtatctgcgtcaggccgggaacgtcttctcccagcggtacgtggagtccaccttcatcgcgtacccggagatcgcccggctgctgctgcagctgttcgaggcccggttctcgccggccctgcagatcggcgagtcggatcgcacccggcgcgcgggtgaggtggcggcgaggatcaccgagctgctcgaccaggtggagagcctggaccaggaccggatcctgcggtcctacctgacgctgatcgaggcgaccctgcggaccagcttctatcagcggggtccggaggggcggccgaagtcgtacgtcgccttcaagctgaaccccgaggcgatcccggacctgccgcagccccggccgaagtacgagatcttcgtctactccccgcggttcgagggcgtgcacctgcgtttcggcgcggtcgcccggggtggcctgcgctggtcggaccggcgcgaggacttccggaccgaggtgctcggcctggtcaaggcgcagatggtgaagaactcggtgatcgtgccggtgggcgccaagggcggcttcgtgctcaagcagaagccgggcgaccgggacgaggcggtggagtgctacaagcgcttcgtgaccgccctgatggacgtcaccgacaacatcctgagcggcaagatcgtgccgccggtggacgtggtccggcatgacggcgacgacccgtacctggtggtcgccgcggacaagggcaccgcgacgttcagcgacatcgccaacgagatctcggtcggcaaggagttctggctcggcgacgcgttcgccagcggcggctcggccggctacgaccacaagaagatggggatcaccgcccggggggcctgggagtcggtcaagaagcacttccgcgacctgggcaaggacacccagtccgaggagttcaccgtggtcggcgtcggcgacatgtccggcgacgtgttcggcaacgggatgctgctgtccgagcacatccggctcgtcgcggccttcgaccaccggcacatcttcctggacccggcgccggacgcggccacgtcgtacgccgagcgccgccggctgttcgacctgccgcgctcgtcgtgggcggactacgacgccggcctgatcagcgagggaggcggcgtctacccgcggagcgcgaagaagatcccggtcagcccgcaggtacgcgccgcgctggacctggccgggtcggtgaccgcgctcagcccggtggagctgatgcgggcgatcctcaaggcgccggtcgacctgctcttcaacggcggcatcggcacctacgtcaaggcggccggcgagtcgcacgccgaggtgggcgacaagggcaacgacgcgatccgggtgaacggttcggagctgcgggtcaaggtggtcggcgagggcggcaacctcgggctgacccagcgcgggcggatcgagttcgcgcgcgccggcggccgggtcttcaccgacttcatcgacaactcggccggggtcgactgctcggaccacgaggtcaacatcaagatcctgctcggtggagcggtgaccgacggcgagctcggcatgccggagcgcgacgagctgctggccgcgatgaccgacgaggtcggcgcgctggtcctgcgggacaactacgagcaggcgacggcgctggccaacgcgcgggcacaggcgcactcgctgctgccggtgcaccggcggatgctgatcgcgctggagcaccgcggtgagctcaaccgggagttggaggcgctgcccacggaccgcgagctggcgctccggtacgagaacggcgaggggctcagcgcacccgagttcgcggtgctgctcgcctacgtcaagatcagcctggaacgcgaggtgctcgccgacgagctggtcgacgaggcgtggaccaaccaggtgctgcaccggtacttcccgaccccgctgcgcgagcggtacgccgcgcggatggccggtcaccggctgcgccgcgagatcatctcgaccgccctggtcaacgaggtggtcaaccggggcggtacgtcgttcgtcttccgcgccatggaggagagcggggcgtcggccgccgacgtcatccgcgcctacgtggtgatccgggacgtgtacggtctcaccgagatctgggcggcggccgaggcgctggacaacaaggtgcccactcccgcgcagacgctggtcttcctggagacccggcgactgctcgaccgcgcggtccgctggctggtcagcacccgccgctcgccgatcgacgtggccggcgagatcgccaagctacgtcccggcgtggcgacgctgctgccccagctccccgaggtgatcgtgggggcggagcgccgctcgttcgaggagcgggtgacgacgctggccggcaagggcgtcccggacgacctggcggacaaggtgagccgggtcttctacggcttcgggctgctggacatcctggagacggcgaccgccatcgagcgggacgtgaccgaggtggcccaggtctacttcgtgctctcggagcgcttcggtgtcgacgcactgctgtcgcagatctcccgcctgccccggggtgaccggtggcagacgctggcccggatggcgttgcggtacgacctgtacgccgccctggccgcgctcacggccgaggtgctgcagtcgaccccggagaccgcctcgccggacgaccgggtctcggagtgggagcaggtcaacgcggcgtcgatcgcgcgggcgtcgaacgcgatgggtgacgtcggggagtccccggccgacctggcggcgctgtccgtgctgctccgtcagatccgcaccctggtgaagacctcgtcggcggcctgatcggcgcgctgggcctgccggccgaggtcggcgggcccagcgctggacagtgacgtcgctcaccgcgacagcgggcggcgcgcgggtcggccagccggcatcagcgcgcgggaaacaagcgtgaaaatgccggtgagccgggccgcggcggactgctcccgaagtccgttgccgcgcccggctcacccgtggcgtcgtgggggcattttcccgatggcaccccgcgacgtctccccagatccaccttcggatatgacgctacgtgagggtcgccgggagcgggaagtgctcagcgtgcactctggccgttcgtatgaggggatttaaccctcggttatccgctttttccgacatcggctacggaccgtgactacacgccgtcgtaacgttcggtgatcagacccagggcggcggcggcgacctcggcgctggccaggctggctccgtgggtgaccaggaaggcgcgtgccccgtccggtcgccaggtcgacggccagcccatctccaccaccgccacgggccaggccgcggccagcttctcggccagctcccggctggccgccgcctgatgcacccgccgcccgaccagcacgatcggccgccccgcggcgcgcgcgatcagctcgtccgcgctggtctcggcggcgttcacgtcgatctgctcgaccgcgccgaggaacggccgcaggccccacggcagcttgccctcggcgatcgagtagccgctgcccagctgtacgaccagcggggcggccaacgcggccgggtcaccctcgaccagcagcgcccggcgggctgcggtgcggcccagctccgccgaggtggtcgcggcggtgcggcccggcgcggccgaggtggttgcgacggttgcggcggtacggtccggcgcaggtgggacggttgcggggatgcggtccggcgcaggtgggacggttgcggggatgcggtccggcgcaggtgggacggttgcggagatgcggcccggcgcaggtgggacggttacggcggtgcggcccggtgcggttgcggtggtcgcggcggggcgggtgatccgctggtgtgccgcccaggcggcgaggtcggcgttgcgggcggccgcctgctcaagacgtacgaccgcgagccggccgtcaccgaccgcggccgcgacctcgtcggcgaccgcgagcaccagctccctgtccacctccgcgccgatgcagagcaggtcggcgccggccgcgagggcggcgaccgcggcctgcgggatcccgcccgcggcgccggccgcgccgcgcatctccagggcgtcggtcacgatcacgcccgcgaacccgtactcgtcgcggagcagaccctgcagcgcggcccggctgaacgtcgccggcccgtcgccggtcagcgccggcacccggatgtgtgcgctcatcaccgcccgcgcgccggccgcgacggccgccgcgaacggggggagatcccgctcccgcagcaccggaagcggcacgtcgacggtcggaagatcgagatgagaatcggtcacggtcgcgccatggcccggaaaatgtttggcacacgcggccactccggccgactgcaggccggcgatcgcggcgccggtgtgccgggcgaccagtccggggtccgcgccgaacgagcgggtgccgatgatcgggttctcggccaccgagttcacgtcgacggtcggcgccaggtcgaggttcactccggcggtggccaggtcggcgccgatcgcggcgtacacctgccgggtgaggtcgaggtcgtcggcggcgcccagcgcggcgttgcccgggtaggggctgccggtccggtggccgagccgggtgacgtcgccgccctcctcgtcgatcgcgatcagcgcgtccgggcgagccgaccgcaaccgcgcggtgagctgggataattcgtcggatgaaccgacattggtgccgaagagggtgtgtcctgcgaggccgtcggcgagcagatccagtgcccagtccggggcggacgtcccggggaaggcggcgagcagggtgcgcagggcgaggcggcggagccccgggtcgatggccatggtgtccttccggtgacggagctctggccaccggcggcggcgagctgccatgatcgctcggagtcgatagccaccgtacgggcgggcaccatcgccgaccgttacgctgcggctgctctccgagcgccgacactgtaacaggaaagaatccttaccattaggggtacgaccatggccgccacccgcctcccgggcaccccccggttgctgcgcgccctcaacgaccgcgcggcgctggacctgctgctcagccgaggtccactgacccgggcccagatcggcgagctgaccggcctcagcaaggtcaccgcctcccagctggtcgagcgtctggaggagcgtggcctggtccgccgggtcggcgagcaggccggcggccgcgggccgaacgcccagctgtacgcggtcaccccgagcagcgcgcacgtgatcggtgtcgacgtcggcccggactcggtgatcgccgcgtgcgccgacatcaccggcgcggtgatcggccgggccgagctgagcaccaaggacaccgacgacccggtcggcgtggtgcaccaggcggtggtccaggccgccgcggacgcgggcaccgacatcacctcggtgcgccgggtcgtgctcggcacccccggcctggtcgacccggccaccggcgagatctccttcgcctgggacctgccccgctggcatcgcggcctgctcgccgacctgcgtcgcgacctgagcaccccggtggtcttcggcaacgacgtgaacctggccgcgatcgccgagtccagcaacggtgccgcccgcggcgtgtccgacttcgccctggtctggatcggtcgcggggtcggtctggccagcgtcatcggcggccggttgcaccagggtgcgaccggcgccgccggcgagatcggctacctgccggtgggtggcgccgaggtgccgcacaacgcctccaagcgcggagtcaagggcgccttccagaccctggccgccgccgaggcggtcaaggcgatcggcaagcagcacggcttccggggcgccgaggccgccgacgtggtgcgcgccgcggtcgccgccggcccggccggtgaaccggttctggacgagctggcccgccggctcgccctcggtgtcgcggccacctgcctggtgctcgacccaccgctggtggtactggccggcgaggtgggccgggccggcgacgccgcgctggccgaccgggtggagcgcgaggtcgccgcgatcacgctggtctcgcccaaggtcgtggtgaccggggtggccgccgagccggtgctgcacggtgccctgcacaccgccctggacgcggtccgcgacgaggtgttcggatcgaccaccgactgaccgggtgagccgcggcacgccgtcgccgggagcggtccgcgcacatggttggatggacggcgtgctggaggctgccgtaaccgttccgcccgacgaggacaccgtcatcgcgttcgaccgcgtcagcgtggtccgcggcgggagtcacctgatcaacagcctgtcctggcaggtggagctggacgagcgatgggtggtgctgggccccaacggcgccggtaagaccaccctgctcaacatcgcgtccggccggctgcacccgacccgcggccaggcctgggtgctcggcgacagactgggccgggtcgacgtcaacgagctgcgcacccgggtcgggatcaccaccggccggctcgccgaccggatcccgccggacgagaaggtgctcgacgtcgtggtcaccgccgcctggtcggtggtcggccgctggcgtgaggagtacgacccgcaggacgtcgcccgggccagggagctgctcgcccagctgggcatgggggcgctggccgaccgggagttcggcaccctctccgagggggagcgcaagcgcacccagatcgcccgcgcgctgatgaccgaccccgagctgatgctgctcgacgagcccaccgccggtctcgacctgggcggccgggagaccctgatcggtcacctgaccgagctggccctcgacccggacgcgccggccatggtgctggtcacccaccacgtcgaggagatcccgccgggcttcacccacgggctgctgctgcgcgagggcagtgtggtcgcggccggcccgctcggcgaggtgatgaccgcggaaaacctgaccaagacgttcggcctgccgctgctcgtcgaccgtttcggcgaccggtacaccgcccgggcggcctgacgtgccaccccgggtggtggtcgtcggcagcgccaacatggacctggtcggcctggccgcgaccctcccgcggcccggcgagacggtgctcggcgacgacttcgtgatgacccccggcggcaagggcgccaatcaggcgatcgccgcggcccgggccggcgccgccacgacgttcctgggcgcgatcggctccgacgcgttcggcgtgacgctcggcgcccggctggccgcgaccggggtcgacatggcccacgtgcgcacgagttacggcccgtccggcgtcgcggtgatcatggtggaccgggcgggggagaactcgatcctggtcagcccgggggccaaccggacgttcgtggacctgaccgaggcggagcgggcctgcatcgccggggccgacgtgctgctctgtcagcaggagatcccggccgggacggtggcggcggcactggccgcggcccgggccgccgggacgcggacgatcctgaacgcggcgcccgcgcgggagttgtggccctccgtgctggacctggttgatttgctggtggtcaacgagaccgaggcccgggccctcaccgacatcaccgattcctcggcgatgtccggcttgctggcgctggtgccgcgggtggtgctcacgctcagcggcaacggctcccgttacgccgaccgggacggcaccgacgtgcacgtgccggccttcccggtcgaggtcgccgacaccacggcggcgggcgacgcgttcaccggcgccctcgcggtcgcctgggcggagggccgcgctctggtcgaggcggtgcgctgggcgaacgccgccggcgcggcctgtgtgcgcaaggtcggcgccagcaacgccctgccggaacgggccgagatcgaagcgatcttcgccggctgaccatcgggccggggtgcgcccggcttcaccgggagacccgcaggccccaggcgatcagcggcgcctgcagcggcagccgtccgaaggcgatcgcccgccgggccggcggggcgtgccgccagtcccaggccatcttgacgttggccgggaagaccgcggcgaacagcgcggcggcggccagtccaccggcccgccgggtccgcggatgggcgacggccgcggccaccgccagctcggcggccccgctcaggtaggtccacgtgcggggcgagccgggcaacgcccgcggcacgatcgcgtcgaacggtttcggcgccacgaagtgcagcacgccgctggtggtgagcagggcggccagcccggccgcgtcccgcctcaccggggcaccgccggctccagcgcgcgcagcagggcccggtagatccggccgaaccgctgcgcgttcgtggtgcgcagcagcagcacgtcgccggcgggcacccggccccagatctcgatggtgcgactgcccgcgtcgtaggaccggtcgacccgctccagcagcaggtcggcgaccggcaccacggccagcccgaccagcacgccgccgatcagcatcgcgacggtgtgcagcgcatcggtgtggagcagcagcgccaccacgaccgccagggcgccgaccgccagcggcgacaggatggccaggccgagcgcgccgcgccgggcgatcaccgaccaggaccgggcacctctggtgtgccagatccggcgcacctcgggcagccggaagtcgcggccgttcatatggatcccggacgaagtgatcagcacgtccggatcccggtagtacgtggtcatctctcctcccccggggacccaatctaaccggtacccgtcgtaggctggcgtccaaacggctaccaacggaggtcggcgtgggcgagttcgtacggctggagatcgcggacggcatcggcaccatccggttcgatcggcccccgatgaacgcgctgaacacccaggtccaggaggagctgcgggcggccgccacggccgcggccggcgacgagtcggtgcgcgccgtcgtggtctggggcggggcgaaggtgttcgccgccggcgccgacatcaccgagttcaccacggtcacctaccagcacatggtgggccgggccgcggcgctgtccggggcgttcgacgcggtcgcccggatccccaagccggtggtcgccgcggtcaccgggttcgccctgggcggcggctgcgagctggccctggcctgtgactggcgggtggtggccgaggacgccaagctgggccagccggagatcaagctgggcatcatcccgggggccggcggcacccagcggctggcccggctgatcggcccggcccgggccaaggagctgatcttctccggccggatggtcgaggccgacgaggcgctgcggatcggcctcgccgaccgggtggtcccggccgagaaggtgtacgagacggcactcgacctggtccgcccgttcgtcaccgggccggccctggcgctgcgcgccgccaagcaggcgatcgacgccggcctgagcatggatctgccggcgggtctggcgctggagtcgcaattgttcgccgggttgttcgccaccgacgatcgggtggagggcaccaccgctttcgtcgagaagcgcaagcccaagttcaccggacagtagcgagccgtggtcctgtcaccgggaccgcctagactgcggggcatgtccatcgaccagggaggcccgaagtatgccctcggcatcgacttcggcacctcgaacaccgtcgccgtcgcacggtggccggacgggcgtgcccgtccgatcctggtcgacggctcaccgctgctgccctccgccgtgttcgcccaggctgacggcacggtgctggtcggccgggacgcggtgcacagcgcccggctggagccggcccgcttcgagccgaacccgaaacggcgcgtcgacgacggctcggtcctgctcggcgagcaggagttcgaggtcgtcgacctgatcaccgcggtgctcgcccgggtggtcgaggagtggcaccgcgccgtcgggccgtaccgtccggagaccacgctgacctgcccggccacctggggcgccacccggcgcacgctgctggccgaggcggccgcccgggccggcctgtccggcgtgcggctggtcgccgagccggtcgccgccgcgacgtacttcgccgaggtgctgggccgggacgtgccgatcggctcggtgctgatggtgcacgatttcggcgccggcacgttcgacgccagcctggtctcgcgcaccgccaccggcttcgaggtgctcgccgtcgacggccgcgacgacctgggcggcctggacgtcgacgccgcgctggtcgagcacctgcgcggcgactcctggcagcgggtgctggagccgtccacggtcgaggagcgccgggcccgccgcgccctctgggacgacgtgcggatcgccaaggagcggctgtcccgcgcccagtccgccgacttcgtggtcccgctgctggacaccgaggtgcacctgacccgcgaggagctggagcaggtcgcccgcccggtgctggagcagaccgtccggatcacgcagaacctgctgaagttcgccgacctgccggagggccggctggccggggtgttcctggtcggcggcgccagccggatcccgctgatggccaccctgctgcaccgcgagctgggcgagccgccggtggtgatcgagcagcccgagctcgtggtggccgagggcagcatcctggcccaggcggcgctgctgacctcggagccggccgcgcccgggctgaccgggcagatgcggttgccgtcgcagacgttcggcgaggagaccgaggtggcgtcggtggctccggcgcccgagccggtcgaggtcacgccggtgcccgcgcccgccgcgacgcccaccccggcggcggccgaaaccgcgcccgccgcgacgacgccggtcacgatgacgacaccggacccggtcgacaaccgggagaccgagatccgcccggagctcgtcgtcccgctgcacctgcggccgccggtcgacccgtgggcggacgcggagccgcccacgtggcagcccgacccggatgccaccctcccgaccagcccgtcgccggcgatgcggcacacacccgtaccgcatcggcagtccgcgccgaaagcggcgccgcagacgaccgcttccggccgtgccgtggtcgccccgccgccggcgccgaagcagcggcccaagccgccgcagagggccaagccggcaccccggcaacagcagcagccgcaacgaccgaccgggtcgaagcggcgccgcagccggacgctgcgcttcttccagatcgtgctcagcgtgctgacgatgatctgcgtcccgctcgccgcgctgatcctgtccttcggctacggcaacgggaaaccgctgcagagggacgcggtcgaggtcttccaggacatcggcaccctgctgcacctgtaccaagaccagaaatgacgccggtcgagggccacggcggggagctcgcgctcgcggccctgcgggccttcggggtgaccgagatgttcaccctctccggcggtcacgtcttcccgctgtacgcggccgcccacgagtccggtttcgggctctacgacgtccgccacgagcagtccgcggtcttcgcggccgaggcggtggccaagctgacccgtcgcccgggtctggccgtgctgaccgccggcccgggggtgaccaacggcatctccgggttgaccagcgcctatgtcaacggctccccggtgctggtgctgggcggccgcgcgccggctttccgctggggttcgggcagcctgcaggagctggaccacgtgccgctggtcgcgccggtcacccggtatgccgcgacggtcaccggcaccgcggacatcccgggcgcgatcggggcggccctgaccgcggcgctcaccccgcaccgcggcccggtcttcctggacgtcccgctcgacgtgatcttctccaccggccgggccgcggcgcccggcgagccggcgatcggggtgctggagcccgacccggacgaggtggccacggccgcccggctgctgcgggacgcggcccgcccggtgatcgtggccggttccgacgtgtgggccggcgacgcggtcgccgagttgcggaccgccgccgaggcgctggacgtgccggtgttcaccaacgggatgggccggggcgccctgccgccggggcatcggctcgccttctcccgggcccggcggaccgctctgggccaggccgacgtggtcgcggtgatcggcaccccgctcgacttccggctgggattcggcgatttcgggtccgcacgggtggtgcacgtcgtggacgcgccggagcagcgcgcgacgcacgtcaccccggctgtctcgcccgccggggacctgcgccggattctcgccgcgctggccggtacgacgggcgggcaccccgagtggatcaccacgctgcgggccgtcgaggacgcggcgagggcccgcgacgccgaggcgatggccgccgagaccgatccgatccggccggcccgcgtctacggggagctgcgcagggtgctggccccggacgcggtcacgatcggcgacggcggcgacttcgtgtcgtacgccggccgattcctggagcccgcccggcccggcacctggctggacccggggccgtacggctgtctcggcaccggcctgggctatgcgatgggcgcccgggtcgcccatcccggccggcagatctgtgtgctgatgggcgacggcgccgccggtttctccctgatggacgcggagtccctggtccggcaggggttgccggcggtgatcgtggtcggcaacaacggcatgtggggtctggagaaacacccgatgcgtgcgctgtacggcttcgacgtggccgccgatctgcagccgggcctgcgctacgacgaggtggtgcgcgcgctgggcggcgccggcgagaccgtggccagggcgtccgagctcggcccggccctgcggcgcgcgttcgactcgggcgtcccctacctggtcaacgtcctcacggatccggccgacgcgtacccccggagtgcgaatctggcgtagagcgacacccatgtcggcccatacccgtagacggcgacggatcgtccgatccggacagtcacgggacgcgacgggttcacatccctatttcagcgtccgggtctgctcgatccggtgagaccgctaccgcgatcgaaatgagcgggcacctgaggcaaccgtacggtcgacctgttggtccttcctttgacaaccggcgacaacggggagggtgcgtggatgccgaggaacgcgtacggcaggcatatgaggcctactaccgacggctggtcatccaggccacgggcctggtaggtgaccttgccgaggcggaggacgccgtgcacgaggccttcgcgcgggtgctggcctcgccgcagtccttcctgcgggccgacgacgccgagcggtggttgcgggtcgcggccctcaatgtcgcccggacccgctaccggcggcggtggctgttcgaccgcctggtccgttcgggccgtgtggcgatcgccccggccgcggtaccggggatatccagtgatcgggtggcgctgttcgccgcgttgcggcggctggcgacaccgacccgggaagcggtggtgctgcaccacctggccgatctgtcggtggcggaggtcgccgccaccctcaacgtgccggtgggcacggtcaaggcccggctggcccgagggagagccgcgctcgcccaccatcttgccgacgatgaattccacccactgcccgcggaggtaggccatgcgtgaacccagcttcgacaagctgcgctccgatgtcggtgacgcggtgcgccagcccgacttcaccaccgtgcagcacagggccggccggatgggccggcgccggcacgcccggcgctgggcggtcaccggcgcagcggtgatcgcggtcaccggtgcggtcctggcgatgcccggcctgggcgatgaccgcaacggagccgcctacgcctcgtggaccgccagtccggagacgctgtccgccggggacgtccaggccatcagccggggctgtgtggcgaagatcgatccactcttcggctacaccacggcgcagctggccgccgcccgcaagatcgtctccgagcgccgcgggagatacggcttcctctcgatcgtcacccacgactgggtcaccacctgcttccgagacagcaccggcaccgtgcggagccccagcaacatggggcgaccggtcagtgacgaagcgctcggccgcacgggtatcgagctgcagggctggggtgagctgcaagccggcgaaggctacatcctgatcatggcggggcacctcggcaccgacgtcaccgcggtagacgtcaacgtgcccgacggcaggacggtacacgccaccgtcgacgaccactacttcctggcctggctgccccagaaggcaggcgacggcgccggcatcaccttcacgatgacactcaccgacggaacgaccatcaaggacatctcggcgaggaaactgacggataaaatggggaccggcgaactcgccgattcgtccggcccatcatgatggcctcgcggtcggcgcgtgcatccgtcccggcccggtgacaccggttggcggtcgtttctaaggttcgtcgtcctggtgcagctcgcgctcccactgggcgagcagttcacggtcgcggcgggactgctcggagtccatcgcgcgcaggaagtccgggtcgtcgtccggtgcggacggccggggggcggggcggcgggcggccgtccgcaccgggcggccccacaggaagtaggcgatcgggccggccagcgggacgagcaccaccaccagcacccagaacggccggggcaggacacgcacccgctccgccgacaggcaggcgatcagtgccaggatcagcaggaccagcgcgaccgcggtcaagaagatgaacaaccggaccatgccgcaatgatgccccgcccgcggcgtaccggcgacgatcagagcatgacaaccagcccgccgaggaccgcgaacgccgcggtgatcagcgcgtacgcccggatcgtccgggccggcgaccgcggcgggcgggcccgcagggcgggggagcggtgcagacccagaccggtcagcgtggcccagccggtcatcgcggcgcccgcgatcagccattgcgccggcccggccgccgggtggaaggcggggcggacggcgagcagtgcgaccgcggccgccgacatcccggtgcgccgccaggccagacgggtgcgttgcgcggcggcgcccggatcgctcatgctgcgaaaatccgatagaggaccatgctgaccagcagcaccgcgccgagcgccacgacgatcgcgaggatcgccgggaaccgggagcggggcaggtcgacaccgagccgcatggcccgctcggcgcgcgcccagtgatcaacggcacgcagggcgaccaccccgccgaggatcagcagcgcgatcgcgatgatctcgcggagccggacgatcggcagcggcggcaggaactgggcgcaggccaggccgccggcgatcagcgccaggccggtgcggatccaggccaggaaggtccgttcgttggccagcgagaaccggtaatccggcgtggtgccctccgagtgggcgctctccgggtcgaaccactgcagcaggccaccgaacacccgccgattattgaccggatcggtcaagaaggtgatgccacagattgcgtacttcgtcactcacgcacgcctcccggaggtggccgcagcggcaccagggcgagtcaggatcggatctgccatgggcgtgcggctccgtttctccgcggtgtgcgagaggatgggggccggtcaggtgcaccgtgccggacatgtcaggaaacctcctcatggaaatgctagtgaggtgtgtcactccgggtggccggcaatcgagaagctactggcgggtaaccttttcgtcatgcccgcggccaggcttggccggccgacgtgcgagagtcgatcgcaacggtgcgttcaatacaggagggtcgtagtagcgcgatgaacatcgtcgtactggtgaagcaggtgcccgactccggtgccgagcgcaccctgagcgcgagcgacaacacggtcgagcggggcccggggaacgtcatcaacgagatggacgagtacgccatcgaggaggcgctgaagatcaaggaggcgcacggtggtgaggtgaccgtcctcacggtcggccccgcgggtgcgaccgactcgatccgcaaggccctctcgatgggcccggacaaggccgtccacgtgcaggacgacgccctgcacggctcctgcgcggtggccacctccaaggtgatcgccgccgccctcggtcagctgaacgccgacctgatcctctgtggcgccgagtccaccgacggccgggtccaggtcctgccgcacatgctcgccgagcgcctcggcgtggccgccctcaccggcgcccgcaagctcaccgtcgacggctcgcagctcaccatcgagcggcagaccgacgagggctacgaggtggtcaccgccgcgacgccggccgtggtcagcgtctgggacaccatcaacgagccgcggtacccgtccttcaagggcatcatggccgccaagaagaagccgctgcagagcctctccctggccgacctgggtgtgtccgccgacgaggtcggcttcgccggcgccaccagccaggtgctggagttcgccaagcgcccggcccgctccggcggcgccaaggtcatcgacgagggcaccggcggcgagcagctcgtcgcgtacctcgccaccgagaagttcgtctgagagagggtctcgtcatggctgaagtactcgttgtcgtcgaggccggcgtcaagaaggtcaccctcgagatgctcaccatcgcccgcgggctgggcgaggtctccgcggtggtgttcggcgaggccgaccaggccaagctcgccgagttcggcgccgccaagatctacaccgcgtccggcgaggacgtggagaaccacggcgcggcccccaaggccaccgcgatcgccgagctggtcaagcgcgtgcagccggccgccgtgctgctcggctccacccaggagggcaaggagatcgccggtcgcctggcggtcaagctggacaacggcctgctgaccgacgcggtcgagctggccgccgacggcaccgccacccaggtggtcttcgccggctccacgatcgtcaagtccaaggtcacccgcggtatcccgatcgtgacgatccgtccgaactcgaccactccggtcgccgcccccgcgtcgccgtcggccgaggcgctcgcggtcaccgtcagcgactcggacaagctggccaccatcacccagcgggtcgccgagcagaagggttcgcgccccgagctcaccgaggccggcatcgtcgtctccggcggccgcggcgtcggcaacgccgacaacttcaagctggtcgaggagctcgccgacctgctcggcggcgccgtcggcgcgtcccgcgcggccgtcgactccggctactacccgcaccagttccaggtcggtcagaccggcaagacggtgtcgccgcagctctacgtggcgctgggcatctccggggcgatccagcaccgggccggcatgcagacctcgaagacgatcgtcgcggtcaacaaggacccggaggcgccgatcttcgagctcgccgacttcggcgtggtcggcgacctgttcaagatcatcccgcaggcggcggacgagatccgcaagcgcaagtaaggctcgctccccgttacggcccggcggttcgctgccgggccgtttcccttttcgcggtacggggtccggccgcagccccgtgggtccacgcccggccgcggcgacccccggatcgctgggcggcatccgggctgggggcggcccctcgcggtggtccgccctctgcgggggctgacgaccgccggccggccttccgatcgtcggtccgctgaccgccggcgctccgccgcccgaagcgttccacggaacaggttctagagttggtagatatggcctacctcgatcatgcggcgaccacgccgatgctgcccgcagcgctggacgcctatgcggccgcggcccgggcgatcggcaacccgtcctccctgcacgcggccggtcgcagcgcccgccggatggtcgaggagtcccgcgagcggatcgccgcggtgatcggcgcccggccctccgaggtgatcttcaccggtggcgggaccgaggcggacaacctggccaccaagggcgtctactgggcgcggcgcgacgctgacggcaaacgccgccgggtggtcgcctcgtcggtcgagcaccacgccgtgctcgacgcggtcgactggctgggccggcacgagggcgccacggtcagcctgctgcccgtcgacggcgccgggcgggtcgatccggacggtttcgccgacctggtgcgcgcgcacggcgacgagatcgccgtggtcagcgtgcagtgggcgaacaacgaggtgggcaccgtgcaaccggtgcccgccctggccgcgatcgcggccggcgccggcatcccgttccacaccgacgcggtgcaggcggtcggccaggtgccggtcgacttcgcggccgccggcgtggccgcgctcaccctcaccgggcacaaactcggcggtccggtcggcgtcggcgccctggtcctgggccgggacgtgagctgcacgccgctgctgcacggtggcggacaggaacgcgacgtgcgctccgggaccctggacacacccggcgtggtggcgttcgccgtggccgtcgagaccaccgtccgggaacgcctcgactatgccgagcgcgtcgccgccctgcgcgacgaactggtccggcgggtgctggccgcggtgccggacgcgatctacaacggtgacccggaccaccggctgcccggcaacgcgcacttctccttccccggctgcgagggcgacgcgctgctgctgctcctcgacgcgcaggggatctactgctcgaccgggtcggcgtgctcggccggggtggcgcagcccagtcacgtgctgctggcgatgggcgcggacgacgcccgggcccggtcgtcgctgcgcttctcgctcgggcacgacagcggcgaggcggatctggacgcgctgctcgcggcgctgccggcggcggtggagcgggcacgacgggcggggtcctggaagacgccccgttagacggcggggtgctcaccgcgtacgagcccatcgtgtggtgaccggttcctggtggttttctcggcgggatccgtgcgcgacgaggggtgcgacggggcccggataggctggtggcatgcgagttcttgcggccatgtccggcggtgtcgactccgcggtcgcggcggcccgggccaaggatgccgggcatgacgtgaccggggtgcatctggctctggcgcgtaacccacagacctatcggaccggcgcgcgcggttgctgcacgctggaggattcgcgggacgcgcggcgcgccgccgatgtgatcgggatcccgttctacgtctgggacatggccgacgagttccacgccggcgtcgtcgacgacttcgtcgaggagtacgcggcgggccgcacgccgaacccgtgcctgcgctgcaacgagaagatcaagttcgcggcggtgctggaccgggcggtggcgctcggcttcgacgccgtggtgaccgggcatcacgcccggctcggggcggacgggctgctgcggcgcagtgtcgacctgcccaaggaccagtcgtacgtgctggccgtgctgacccgcgagcagctggatcgggcgattttcccgctcggtgactccacgaaggagcaggtgcgggccgaggcggccgcgcgggggctggcggtggcggacaagccggactcgcacgacatctgcttcatcgccgacggtgacacccggggcttcctggagcggcgcctgggcgccgcgcccggggacatcgtggacggtcggaccggggcgaagctgggcacgcacaacggggcgtacgggttcacgatcggccagcggaaagggctggacctgcgggttccggccccggatgggcagccccggtatgtgctttcgatcacgcccgtgtcgaacaccgtgacggtgggccctcgggaggacctcgaggtggacacggtcacggccacgcgtccgatctggcacgacggttccgacgaaacggagtgcgaggtgcagctccgggcgcacggggaggtggtggccgccacggtcgcggtggattcctcgggattcgtcgcgacgttgcggacgccggctcgcggggttgccgcggggcaggcgatcgtggcctaccggccggatgccgcgggggacatcgtgctgggatcggcgaccatcacggccgcgacgcggtcatccgctgcgacgaccctgccggagtccgcgcatgcctgatcttccatggcccgccggtgccgcgaccgggatcggatccctgcccggcacggacgtcgccgaggcgcagcggatcgtcctcggtgagctgcccgccctgccgcacctgcccgagcttcccgagcgtggcccgggcgccgacatgatcgggcgcggcgccgggttcctcgtcgagctgccggtgcagctctacgccgggcgctggcagatcgccgcgcggccgggccgggacctgcggcgtaccgccgatctgctggaacgcgatctggaccagctcaccgagcaggccgacggcttcaccggcgccgtcaagatccaggcggccggcccgtggaccctcgcagcgagcgtcgacctgccgatcggcggccggctgctgcgcgacccgggcgcggtccgggacctcaccgactcgctcgccgaggggctccggcggcacgtcgccgacgtccgcaagcgggtgcccggcgccaccgtgctgctgcagctcgacgagccgtcgctgccgtccgtgctggccgggcgggtgccgaccgagagcgggctcggcgcctaccgggcggtcgacggcccggacgccgcggcccggctgcggaccgtggtggcggcggtggacacccccaccgtgctgcactgctgcgcgccggacgtgccgtggcaggtgatccgggacgcgtcgttcgcggcggccgccttcgatctgtcgctgctcaaggatctggacccggtcggcgaggcgatcgaggccgggctgggcctgctggtgggcgccgcgccgacccgcccggtggccgagcggcgaccggacgccaagcagatcgccgagcgggtgcagaccctgtggcgccggctcggcttcccggccgcccggctgccccggcaggtggtgatcacgccggcctgtgggctcgccggtgcgccccagccgtacgtccgggccctgctcaaagcctgtcacgaagcgggccggcggatctccgaggtgtgatcccgaaattgtcggggggtgggactaccgtgcgtcctaggtgttcgcagacacggaggttccggtgaccacacccagcgcagagcccacggcggtggccgccgcccggcacgccgagctcgccgacgagatccgcgaccatcagtatcggtattacgtgctcgacgccccgatcatctccgacggccggttcgacacgctcctgcgcgagctggaggcgctggagaccgagttccccgcgctgcgcacccccgaatcgccgacccagctcgtcggcggctcgttctccagcgacttcgccccggtgcggcacgccgagcggatgatgtcgctggacaacgtgttcagtttcgacgagctgagcacctgggccgagcgcaccgtgcgggacgccggtggcccggtggcgttcctctgtgagctcaaggtcgacggcctggcgatcaacctgacgtatgagaagggcaggctggtccgcggcgccacccggggcgacggccgcaccggcgacgacgtgacccccaacgtgcgcaccatccgcgagatcccggagcggctggccggcgacgatgtgcccgacctgctcgaggtgcgcggcgagatctactttccggccgaggcgttcgccgatctgaacgcgtcgctggtcgagcagggcaaggccccgttcgccaacccgcgcaacgccgccgccggcagcctccggcagaaggacccgcgggtcaccgcctcccgcggcctgcgcatggtggtgcacggcatcggcgcgcgcgagggtttccaccccacctcgcagtcgcatgcctacgaggcactccgggcgtgggggctgcccaccagcagccggtggaaactcgtcgacgacatgcccgccgtccgagagttcatcgagtattacggcgagcaccggcacgacgtcgagcacgagatcgacggtgtcgtggtcaaggtcgactcggtggcgatccagggccggctcggctccaccagccgggcgccgcgctgggcgatcgccttcaagtatccgcccgaggaggtcaccaccaggctcctcgacatcgcggtcaacgtcgggcgcaccggccgggtcaccccgttcgcggtgctggagccggtgctggtggccgggtccacggtcgcccaggccaccctgcacaacgcgcaggaggtggcccgcaagggcgtgctgatcggcgacaccgtggtgctgcgcaaggccggcgacgtgatccccgaggtgctcggcccggtgatcgacctgcgcccggatgacgcccgggcgttcgtgatgcccaccgagtgcccgtcctgcggcaccaccctggccccggccaaggagaacgacgtcgacatccgctgccccaacagcgagtcctgcccggcccagctgctgggccggctggccaccctggcgagccgcgaggtgctcgacatcgaggtgctcggcgagaagtccgcggccgccctgctcgagtccggcgtcctgcacaacgagggcgacctgttcgacctgaccgaggacgacctgctgcgggtgccgttcttcgtcaacaagaacggcaagctcggtacgaatgccggcaagatgctgcagagcctggccgaggcgaagggccggccgttcgcgcgctatctgatcgccctgtcgatccggcacgtgggaccgacggcggccaccgcgctggctcgggaatacgggtcgatggatcggctggaggaggtgctcgcccagaccgcggcgcagccggccgcggtcgcggccagcgctgaggccgcctccctcgcccaggccgcttccgccgttgaggccgcttccgccgctgaggccgcttccaccgccgaggccgccggcacctccgcctcggtcgccggatccgctgcctcttccgggtcggtctcctccgatgcgtccggctccggtgcggcttccccggggaccgcggacccggccaggggaagcgacggggcggattccgcggaccctaccggggagggcgacggggcggattccgcggacccgaccggagagggtgacggggtggattccgcgggggccgccgtcgagcaggcgaagcggaaggccaaggcgatcgatccactcgccgccgtcgacggggtcgggccgatcatcgcggacagtctgcgcgagtggttcaccgtgccgtggcatcgggagatcgtccgcaagtggcgcgaggccggcgtgacgatggtcgacgagcgggtcgaggccggtccgcgcacgctggaggggctgaccgtggtggtcaccgggacgctggccggcttcacccgggatcaggcggccgaggcggtcacctcccgcggcggcaaggtcagtggctcggtgtcgaagaagaccggcttcgtggtcgtcggggagaacccgggcggcaaacacgacaaggccgtcagcctgaaggtgccggtgctcgacgaggccggcttcgaggtgctgctgaaggacggtccggaggccgcgcgggaggttgccgagctgggctgaggcgacggtcccgacggcgcgcggagggacagcaccaggcggtgacctgtcatgccatggagtgaattgcggctttggttgcttctgcggattccgttacgggtaagacgttggcggcatttgcgcgatttagatctatggtgtgagcgatcggtgatcgaggccaatcgtggaggtcgcatggatgccgttcgtccccgtacggccgcctccgggccgcgtcggcggcgcgcgctgctcgtcaccgtgggttcgaccgcgggcgcggagctgagtctctggggggccgcgcccgggatgttccgcgggctgccggccgtctactggatcatggcggggctggcggtggccgccgacctgcggccgcacccgctgcccggccggcgggtcagccgggtcgtgctgccgtccatctgcttcaccttcgccatcgtgctggcctggggtctgctgccggcgctcgccgtgcaactggtcgcggtgaccgtggccggcgcccggatgcgccagccggtcccgcgcacggtccacctcgccctgcagcacgtcgccggcctgggcgcggcggccctggtcatcgcactgaccggcgggcggatcagcccgagccccggtccgcgcgacgtggcgctcacctgtgccgcggcgggcgcctggatcgccgcccgatacgccgtggcgtccctggtgcgccggtggaccgcggaacggcgtacccgcaatcgccgccgggccccggcggacctgatggcgacggcggccctgcttctgctgtccccggtgctgctcgtcgccgcgcgggtcagcccggccctgctgccgctcgccctggtggcgctgcacgccgtgcaccggatggtccgctgggccggcgagtcggagcgggccacccgggtcgacccgctgaccggcctgccgaaccgccgcgccctgcagtcgaccatgtccgagcgcggcccggaccggcagcgcgcgctgatcctgctcgacctggaccggttccgcaccgtcaacgacgcgctcgggcacggtgccggcgaccggctgctggcccgggtcgccgaccggctgaccgccgccgtgccccggcacgacctggtggtccggctcggcggcgacgagttcgcggtgctcgccacccgggtcgagggcgccgcctcggcccgccggatcgccgagcatctcaccgaggcgctgagccggccgttcccgatggacggcaccccggtcgagctgaccgcctcgatcgggatcgcgctgcagtccggccgccgcgacggcgccaccctgctgcgcgaggcggagaccgcgatgtacgaggccaagcagcgtggtgaccaggtggcggtgcacggcccggacgcgccgcacgcctccccggaacggctggccctgctcgccgacctgcgtgacgcgctgcggcacgacccgcccgccgacgggatagtcctctactaccagccgcagatcgccatcgcgaccggcgaggtggtcggcgtcgaggcgctgctgcgctggcgacacccgcggcgcggcctggtcggtccggacgagctgctccgggtggccgagccgaccccggtgatgcgcctgctcaccgcccgggtgctggacgaggtgatcgcccagctggcgcggtggcgctcggaggggatgccgctgcgggccgcggtcaacgtgagcgcccgggacctgcacgccggggaggtcgccgaccgggtcggccggctgctgcgcgaccacgaggtcccggccgacctgctgcagctggagatcaccgagagcgcgctgatgaccgacccgcaccgggtgctggacacgatcacccggctggaccggatgggtgtggcgatctccctggacgacttcggcaccggctactcctcgctgcagcacctgcgtcggctgccgctggccgaggtgaagatcgaccggtcgttcgtgctcggcatggccaccgatccgggtgacgcggcgatcgtgcgctcggtgatcgggttggccgactcgctggggctgcgcgcggtcgccgagggggtcgaggacgaggccacctggctgctgctcgcggcggccggctgccatgccgcgcagggctggttccacgcccgtccgatgcccgccgacgagttggtcgagtggttgtcgcggtaccggccgattcgccccggggttcggcgcgggccgtggatcccggcgaaatagactcggtgcctgcatgcacgcatacatcaagaacgagggggcaggatggccgccatctcccgcgaagaggtagcgcacctggcgcgcctgtcgcggctcgccgtgaccgaagaggagctggatcgattcgcgggtcagctcgacgtgatcctgcagtcggtcgcccgggtcggtgaggtggccgcggaggacatcccgccgacctcgcactcggtgccgctgaccaacgtgtaccgcgacgacgttccccagccgagcctcgaccaggacgccgccctctccggcgcgcccgacgcgtacgagggccggttccgggtgccgcgcatcctggacgaggaggactgatcgtgaccgacctgaccaagctgagcgcggcctcgctgagcgggctgatcgcggcacgcgaggtgtcggctgtcgaggtcgccaccgcgcacctggaccggatcgcggccgtcgacgatcgggtgcacgcgttcctgcacgtcgaccgggagggcgcgctggccgccgcccagcgggtcgacgacggcgagatcaccggtccgctggccggcgtgccgatcgcggtgaaggacgtggtgaccaccaagggcatcccgaccacggccgcgtcgaagatcctggagggctggaaaccgccgtacgacgcgacgatcgtcgagcgtctgaaagcggccggcatgccgatcctcggcaagaccaacatggacgagttcgcgatgggctcgtcgaccgagtacagcgcgtacggcccgaccaacaacccgtgggacctgggccgcatcccgggcggctcgggcggtggctcggcggcggcgctcgcggcgtacgaggcgccgctggcgatcggcaccgacaccggtggctcgatccgccagccgggtgcggtgaccggcacggtcggcgcgaagcccacctacggcggcacgtcccgctacggcctgatcgccttctcgtcatcgctggacacccccggcccctgcgggcgtaccgtcgaggacaccgcgctgctgcacgccgcgatcgccggccacgacccgcgcgactccacctcgatcgcccagccggtgccggacgtggtcgccgccgcccgccgtggcctgcagggtgacctgaccggggtgaagctcggcatcgtcaaggagttcgccggcgacggctccgagccgggcgtcctggccgccttcaaggagtcgctggaggccctggtcaagctcggcgccgagatcgtcgaggtgtcctgcccgcacttccagtacgcgctcccggcgtactacctgatcgcgcccagcgagtgctcgtcgaacctggcccgtttcgacggtgtccgttacggcctgcggtccggcgacgacggcagccgctccctggaggaggtcatgtcgctgacccgcgaggccggtttcggccccgaggtcaagcgccggatcatcatcggcacgtacgcgctgtccagcggctactacgacgcctactacggccaggcgcagaaggtccgcaccctgatcacccgcgacttcgaggccgcgttcgagcaggtcgacgtgctggtctcgccgaccaccccgttcgtcgcgttcccgttcggctcgcgcacctcggacccgtaccagatgtacctggccgacctgttcaccatcccgaccaacctgtacggcggcccggccatctcggtcccgtgcggcctgtccgagggtctcccggtcggcttccagatcatggccccgaccatggccgacgaccgcatgtaccgggtcgccggcgccctggagtccgccatcggcaccttcaccccgccgaccctctgagcagcggcaccggcacggctctcgcagccgtgccggcgccgtcgccctacttcggggtggacggggaatcgagccagctgtcgatcagcttgctgtagtccgtgccggtcttctcccggacgaaggcggtgaacgcggcccggtcctggttcgtccccttgtgctcggcgacccacgccttcatcaggtcgaagaacttcttgtcgcccagggcgtcgttgagctgcttgagcatcgccgcggtgcaccggtagacgttgctctcggcgaagttggcggctttcggcttgccgggcgggcccaccgatttgcgcagccgggcgtcctgctggcggaggaaggtctccagctgggcgtcggtgagcttgtagaccttctgctcgtacaggtactgcatgtactgggcgaagccctcgttgagccacaggtcggtccagtcggacggggtgaccgcgtcgccgaaccactggtgggcgtactcgtggacgaggatctcgtcgaagtacgccgggtcgaacttctggccggtggcctgacggccgatgctgagcatctgctgggtctccatggccgagaccgagtcgctgagcaccgcgccggcggtgtcgaacgggtacgggccgagttgtgcctcgagccagctgaccagttgcggcgacttcttcagctcggtgagcagtctgtcgtcggtcttcgccaccgtccagtaggtgaacttcaggccgtgcgcgccggtctgcgacgtcttgcggaaccggtcgacggcgagcgtggtcaggtacgcggcggtcggcgccgccgagctgtagtggtacgtggtgccctcgaccgggccgggggtgccgctcgcggcggccgcccagccctgcggcacggtcaccgcgatgtcgtacagcgccttgtcggagaccagctcgttggccgggtaccaggtcatcgcgccccacggttcctgcatggtccacaggccgccgctcctggtcgggcgcaggccgacgccctcggcggcgtcgccgcggtgggacgggtaggcgacctgtctcggtgtgccgtggtagtcgacgaccagggtcaccggctgttcggcggtcagggtggcggggacggtcagcttgtccttggcgagcgtgccggtggccggccgtccgtcgacggtgaccttgtcgacggccaggttggcgaagtcgagactgatctcactcgccgcggtgaccgggcggatctgcagggtcgccgtcccggtcagcaccttgctcgtgggctgccagtcgagtttcaggtcgtagtgcaggacgtccaggccggcattgccgtgctcggggtacagccggtcggcgaccgtgaccgacttcccgccctgccaggcggtgtagtcgatcgcgggggcggcggcgggctgcgacgcggtggcgacggcgggtggtgcggccttgtccgtgcagccggcgcacaggaccgtcgcgccgagcgccacgacggcgagatatcgatgcatgccgcgcaggttatcgtgaggaatattcgcggtggaaccgatgaacggccgctcgcaaacccgacgacgggacgtcataccggacgactaggctagtcgggaagtacgtacacccgatgccgcagtgagccggagccgaagcacatgaccacgatcgcgctgccgtcctacgacgacgccctcagccgttacgagccggtcatcggcctggagacgcacgtcgagctgggcacccagacgaagatgttctgcggctgccggaccgagttcggcgccgagccgaacacccaggtctgcccggtctgcctggccctgcccggcgccctgccggtgatgaaccgggcggccatcgaggccacgatccggatcggtctcgcgctgaactgctcgatcgcgtcgtggtgccggatggcccggaagaactacttctatcccgacatgccgaagaacttccagacctcgcagtacgacgagccgctctgcgtcgacggatacgtggacgtcacggtcgacggcaaggagtaccgggtcgagatcgagcgggtgcacatcgaggaggacaccggcaagacgctgcacgtcggcggcgccaccggtcgcatccacggcgccaccgagtcgctggtcgactacaaccgggccggcatcccgctcgtcgagatcgtcaccaagccggtccccggcctcggcgcgctcgccccggagatcgccaaggcgtacgtcgccgagctgcgcgacatcgtccgctcgctgggcgtctccgacgtgcggatggagcagggctcgatgcgctgcgacgtcaacacctcgctgaacaggccgggcgaggagtggggcacccggaccgagaccaagaacgtgaactcgctgcggtcggtcgagcgggccgtccgctccgagatcatccggcaggccggtctgctcgacgagggcgtccggatcttccaggagacccggcacttccaggagacgaccggcgacacccggcccggccgctccaaggagaccgcgaccgactaccgctacttccccgagcccgacctggttccgatcgcgcccgacccggcgtgggtcgaggagctcaaggcgtccctcccggagaagccgagcgtcaagcgggcccgcctccgcgaggactgggggatgaccgagatcgacatgcagtcggcggtcaacgccggcgcgatcgagctgatcgaggagaccatcgcggccggcgcctccccggccggtgcccgcaagtggtggctgggtgagctggcccgccgctccaacgagctgggcgtcgagctggcgcaggtcggcgccaccccggcacaggttgctgagctgcagaaactcgtcgacgacgggaagctcaacgacaagctggcccgccaggtgctggagggcgtggtcggtggtgagggttcgccggcgcaggtgatggccgcccgcggcctcgaggtggtctccgacaccggcgcgctgcaggccgcggttgacgaggcgatcgccgcgaacccggacatcgcggacaagatccgggacggcaaggtcgccgccgccggtgcgctggtcggcgcggtcatgaagaccacgcgaggccaggccgacgccaagaccgtccgcgacctcatcctttcccggctcggcgtctcctgattgccgcggtacgccgtaatccgcccggcccgtcgccccgacgagccgggcgggtccggttcagcggctcggcgtgacgggtggatccggttcagcggctcggcgtgacgggcgggtccggttcagcggctcggcgtgaccgccgggctgcgtcccgcccctgacggcaccgaggtggccggagtgacagccggctgctccttgtccaggccgaccacgttgcgctgcatctcgacgttcgattcgccggtgccgcccagccggatgtcgtcgtacgccttcagattgtggttctcgtcgaagtagaggaccgacagggagagcggggtgggctcctcgccctccagaccgcgcaggccggcgccgccggtggaaccctcgaccatcagccgggtcgcgatcggcggcggcgcggcggccgccgacaccgacggggtgggggagggggccgccgaggcggacgggtccggggccggcggcttccaggccggcagcatggccaccgaacgctggtgccggtgcccggccagcaccaacggcacgacaccggccagcggcggagccatctccgggtcgtggatcagggcgatgtcgacctttttgccggagtcgcggatggtcttggcgagccggtcgccggccgcggtgagaatctccgaaccggaggtgtcaccggccttgttcgtctcgctcttgtccggggtgaactgcggatccccgatgccggcgacggtcagcccgtcgaccgtggtgagcttgtcgtccagcacgaccgcgttgcgctggcgggcgaccgcggactggatcgccaccgagtcgtggttgccgcgcacgtagagatacggcacgttcagcgacgggatgctcgacacgtacgacgtctcggcgctgctgccccagtcgaccatgtccccggtgtcgatcaccgcgtcgatgtcgaaggtctgcaccacggtgcggatcaggccccacgacgacgggttcaggtgcaggtcggagacgtgcaggatgcgggtggtgttgccggccggctcgtacaccggcagcgccgacaccgtggtgtagatccggctgacgttgctgacgatctgctgcaactgctcggcgtaccgcccgtagttgtcggcgatccgtcgcgcgtcaccgaccacggccggggcgttcaccagcagtccctcgtaccgcggctcgctgatcgcgtcgggccgcagggtggcggcggccacgccgaaactgccggcgccgaccaccagcgcggtcacgccggccgccgcggtgcgccggacactgcggaagatcagggcggcggccaggatcgcgcccagcacggccagcccgatggcgcgcagggccagccgggtgacgccggtggtgacctcctcgaccgcccggtccccggccgaactgatcgccgccggattgtcgatcagcgcctcggtgcggctctggtccagcgagccgagcgccaccttgaggtgcagggcgccgcggtggctgtccaggtgcagcgagccgagcggcgggatgtccacctcggtgccgccggccagggacgggctcagcgacatctcggcgcggaacggtccgacgttgatgccggtgtgcgcgaacagcatcaccccgatcatcgcggcggtgatgctgaccaggccgaccgcggcgctgatccgggcgccgcggaaccagcggtgccgccacacccggacggtggagtcggcggtcgaacgcaggcgtcggcgccaggagggcgtgggctcactcatcggggcctcacctgcccagcccggcccggcccgaaacagtcatcgccgtctcatccccccgcacggtcatccgtcgtcgcgctcccgccccgctcaccggcaccgcggtggctgggcagtcgtcgtggtcatcgccggctcagctccggccggcgccgccgtccgagaagacgagccggatcaggcggtcgtcctccggatcgggctcgccggcgtcctcctggttggaggtgctcacccagagcgagccgtccggcgcggcgaccagcgcccgcagccggccgtacttgtcggtgagcagctgttgcggggtgcccagcacggtgccgttggcggtcacgttgagcaggtagatccgcttgccgagcagacaggcggtggcgaccaggctctccatcgccgccacgccgccgcacgacgactcggcgctcggccaggcggccagcggatcggtgagcttgctgtcgcccgccttaccgtcggctttcggccaaccgtagttgctgcccttctccacgatgttgagctcgccgaatttcggctgggtgctgtcggtggcgaacatccgtttcgtcttgtcccaggtgatgccctgcacgttgcggtgcccggagctccagaccggcgaatccttcaccgggttgcccggggccggcttgccgtcccgggtcagccgcaggatcttgccgcccagactcttcggatcgggcgcctgggtgccggtggtggtgccgtcgccggtgccggcatagaggaaaccgtccggcccgaaggcgagcgcgccgccgttctgctgggccgagcgggggatgccggtcaggatcggctccagcggtttgccgagaaccagccggccgatccggttgtcggtggcggtggagtagtagacgaaaaccgtcttgtcggacgcgtatttcggggagatcgcgatgccgagcaggccaccgtcgccggaggcgcgcacctcgggcagccgggccgcctcggcgaccttgagaccgtcggcgtccgacccggggcccaccttcaggatgcggccggtgtcgcgctcggtgaccagggccgacccgtcgggcaggaaggcgatgccccacggcacgtccagacccttggccagcacggtggccaccacgtcgggctcacccgggtcggcgctggaggtggcggcgaccgaggggccgggcaggttgggcgcgctgccggcctcatccgggccgggcgggccgaagctgcaccccgaggtcagggccagcacgacggcgagtgtcgcgatcgcggcacgggcccggcgggaacgcacggcggaaccaccccctagcttgtctgccgatcagggtagccgcgtccgctgacaactcccggggaagtggtcaccggtccacttcggcggggtccgccgcgtcgaccggctcgtcggtgccggtcgcgggctcgtcggccggctcgtcggtgccggtcgcggacttgccggccgcgtccagcaccagcgagacgttgtcccgggtcacgccggtcagccggatcacgttcccgttgtcgagcagggccgacacccggccgcgctggtcgggtgccagcccggtgatccggctccagggcacccgggtgccgccgaacagggcccggacgagcacctcgtccgggaagacgtcggtgcccgagcgccacgcccagaccagcgcggtcagcgggatcagcagcagcggcgcgagcgcccaggaggtgccggccagcggcaccgcgctgaccaccgcgatcccggcggcgaccagggcggtgccggatttacggacgcggagggcgggacgtcggctcacccggccattgtcccactcgcgttcgacgagccccacccgggttttccggccctccggcccccggcccgcaccgtcatccacagggtcgggcgccggagtcgtccaccggcccgattgaccgccgtccgtccatggtcgacgatccgggatgaggccacccgtaacccgttccggcgaatcctcgttgttcgggtgcaacgacctcttgttccgccccgcatgtcgggagccgttcccccggcacgaacgcagaggacctgtcgtggctgtgtcgcccctcgcgccggcccggccgagcaacaccggccgggcggccctgttggccgtctgctcggcggccgcgctggtgctgctcaccggcgttttcggcctgttgcccggcccgctcaccctggccgtgggcgtgggcgtcgccggcctgtgcgcgtccgcctacctggtgcacgccgctctcgacatccaccacgccgacggcaccttcgtggcctgccgcggcgccggcttcgtcggaatgggcgcactggccaccgccctcacggcgctgatcccctggtggtcgccgccgcacgcggtgctctggctgaccgccgggctgggcgtggccgccggctgctacgtgctgggcgccgcgctgctgcccaacgcggcccgcacctggccgatccggctccggcgcggcttcgacggcctgggcctcggcgtcagcctgggatacgcggcctatctgatcccgcccgacggacagacccgcccggccgcccttccggcgctgctgatcaccgcgggcggcgtgtcgatcgtcacggtcgtggtgctgcgcgctcggccccgcccggtcccgacggtctggtgcggctgcggggcggccgtggtgctggccgcgctcgccgccctcgccgaggtgctggcgctcggcctgaccgggccggccgtgccgctgctcgggctggcctagctagctaggccgcccgccgagccgcgcagccctgatcagtatctggcgagctatccgctgctggcggtcccggccgtggtcggggtggccgccgcgctctggcacctggtcaccacccggcacttcgacgccggggggatcgtcttcggcatggtgatggtcagcgtgctggtcctgcgcgagctgctggtggtccgcgacatccggcggtacgcgggccggctgcggatcgccgaggcgcacttccggtcgctggtggccggggccaccgacctcaccctggtgctcgacgaccggctcacggtccggtggcagtcaccggccgcggcccggctgttcgggctgcacgacaacgaggtggtcggccgggcgttcggcgacctgattcatccggaggacgccggcgacgcgctcgcggtgatcgggtcggtgctcgccggtgagcacgagggcgggccgccggtgctggtcagcgcccgcctgcgggacggctcgcagctctggcgggacaccgagtccacgatctccgaccagcgcgcggtgcccgaggtggccgccctggtggtgcacgtgcgtgacgtcggcgagcgccggcacctggagcgcaccctgcaccggatggcctacctcgaccagctcaccggcctggcgaaccggcgtgccctgatgcgcgacctgctggccgcccgccgccggccgggtggtcccggcaccctgctggtgatcgacctgcacgggctggccgaggtgaacgacacgcacggccgggcggtcggcgacgcggtgctgaccgaggtggcccgccggctgcgcgcgctgtccggcggcgaggacgtgccggcccggctggccggcgacgagttcgcggtgctcaccccggagtccgccgtcccggcctatgcgctggccacccgcctggtgtcggccctcgccgagccgtgccagctgcccggggcgcaggtgcggctgcacaccagcgtcggcctggccgagctggccggcgccgccggcccggaggaggtgctgcgccaggccgacctggcccggcagcgcgccgcccagctgggccgggacgccgtcgagtggtacgacccggacgtcgagctgcacctgcagcgccggatggagctggaacgccagctgcccggcgccgccgcccggggcgagctggacctggtcttccagccggtgagcgacctgcgcgacggccacccggccggggtggaggcgctgctgcgctggcggcatccggcgctgggcacgatccggcccgaggagttcctgccgatcgccgcggggctggggatcaccgacacgctgaacgagtgggccctcaacgacgcctgccgccacctgcggaactggaccggtggtgacgacgacttctgggtgtcggtcaacgtcggtccgcgggagctgctcaccgcccgcttcccggagcaggtgcggaccaccctgcggcggcacgcggtgaccccggaacgcctggtcgtcgaggtcgcgcagacctggatcgcggaggacgtgccggccgtggtggcggcgctcgccggactgcgccggctcggggtccgcgcggcgctggacgacttcggctccagccagacgtccctgacccacctgcgccggctgccggtcgacatggtgaaactgagcgccgagctggccggtgcggaggccgggaaaccggtgctcgacgtggtggtgggactggccaagcggatcggtctcgacctggtggccaagggcctggagacaccggagcagatcgagcgcgtcctggccgcgggctgccggtacggccagggcacggcgctggtgcccccggccccggccgagcggatcgaggcctacctggagacgcaccgcgccgaccgcggcagctgaccggtcgccgccaccgcccgccgcgggtcaggcggggcggggtggggcggtgctgccgcggggggtgaggtgcgcggtctgggctttgacgttgccgacccgtctgccgtcgatggcggtcaggagctcgcgggcggcctgggcgccgtagccggagacgtcccggctcagggcggtcagcggggggtggaccaggctgcacagcggggagtcgtcccaggcgacgatggacaggtcgccggggacggagaggcccatctcctgtgcgacggccaggccggcgaccgccatcacgtcgttgtcgtagatgatcgcggtggggcggccgccgccgatcagcagccggcgggtggcacggctgccctcctcgccggtgtagtcggccgggacggtgaccgcgtcgccgaggcccagggcggcgcagacctcgttgaacgccttcgtgcggacctgggtgtgcagcaggtcgggcaccccgctgacccgggcgatccgggtgtggccgagcgccaccaggtagcggaccgcctcggtgatcgcgccgccgtcgtcggaccagatctgggtgacgccgccgggctcgccggagccgccgatcaccaccgcgggcagctgcagctgctgcaggaccgggatgcggacgtcgttctcccggaggtcggtgacgatcacgccgtcgatccggcgctcgccccaccagcggcgatagacctccacctcctgctcgggggtggcgaccacctgcagggtcaacgcgtacgactgggcgccgagctcggcctcgaagccgctgatcaggcccatgaaccagggctcgatgccgaggatccgggcgggccggcacagggtcagaccgacggctcgggcgcgggcgccggagagggctcgggcggcgctgttggcgttgaagccgatctcctgggcgatggccaggatccgcttgcgggtcgcctcggacacgccgggctggccgttcagcgcgtaggacacggcgcccttggacacgccggcccgccgggcgatgtcggcgatggtgggccgtttcacgcagtctcccgttccgggggtggtccgaattgccgctgagcctatccggcggtgatgcggcgaaccggacccgaccaggtgatccatagtgtacttgaccggttaagtcagggggagatcaatcgggatccctctcggggcccgccgagcatgatgtcgtgggcggtcagctcgccgatcaactccacccggtcggccaccggcgggtaaccgctcgcggtcaccgtgtaggcgccgggcaccaggtcggcgaaggcgtaccggccgtcggcgtcggtccaggtggtggcgaccacggcgccggcctcgtcgaccgccatcaccgaggcttccgggaccgggtgcccggaggcggccgcgcggacctgtccggtcagcgtgccgttgccggccagcagcaggtcggcgcggctgaccccaccggtgtccaggaccacggtgcgggcggccgggcgggcgccgggcgcgatcccggtcagcgtgtactcggccgggtacaggccggcgagcacgtatccgccgtccgggccggtgatcgcgctggcgaccaccgcgcccgcggcgtcggtgagggtgaccgtggccgccgccaccggccggtcgtgctgatcgacgacgtcgccctcgatccgcccgccggccgccaggcggacgtcgcgggcgtcggctccggtcacggtgagccggatcgccgccggttgatgccggtcggcggcgcagatcagcaggtacgccccggccacctccggggtgagcaggtaccggccgtccggtccggtcaccgcccgggccgcctggcccccggcgaggtcggccagggtgagccgcgccccggtcagcggccgctggtcaaggccggtcaccacgccactgagcgagagcgcgtcgaccgaccgggcgggcggggagggggagtggggcgatcgggaggacgcggggctggcggtggccgatcccggggacggggagaggtcggtggccgagcccgaggacggggagagctcggcggggccggccggcgcggagccgcgcagcggcacctggggcaggaacgcgaacaggatcagcgccaccgtcagcaccccacccgccaccaggcagatgtcggcgatcgtggcggcgaacccgctctcgaacggccgcgccagtaccgggtcgacgtgccgcaggaacgaggtgtcgtcgagcgagccgccgagcacccgccggttcgccgggtccgccatcagcttctggaacgccggatccgccccggccacccgcagcgcgtcccggatccggtcgcccacccgggagaagagcaggctgaggaagaccgcggtcccggcggtcgcccccatctgccggaagaaggtcgccgacgcggtcgccacccccatgtcctgtggcggcatcgcattctgcacggccagtgtgaccggctgcagcacgaaacccaggccgagaccgaacaaccccatgaagaccccggttcgccagtacggggtgtccaccgcgagtgagtgcatcaatcccatcccaccgatcatcagcggggcgcccagcatcggccagacccggtaccgcccggtggcgctgatcgcccgaccggagatcagcgagccggccatgatcccggcggtcagcggcagcagttgcagcccggagcgggtgggcgaggcgccgtgcacgatctgcaggtagagcgggagcagggcgagcccgccgaacatccccatcccggtcacgaacccggcgaacgaggtgagggcgaacgtccggttccggaagaaccgcagcgggatcagcgcctcggcgcccatccgggcctcggcgaccaggaacgcgaccagtccggccgcgccgacggcgtagcagagcaccgtgcggctccccgtccagccccaggtccggccctgttcggcagcggtcagcaggggcaccaggcagacgcacagcgcgaccgcaccccaccagtcgatgcggtggtcgcggcgggtgtgccgcaggtggagcaccttggcgaccacgaccagggcgaccgcgccgatcggcacgttgaccaggaacacccagcgccagccggacaggccgaggatctcgtcggcgccggcgaagaagccgccgatcaccgggccgagcacgctggacgcgccgaacacggcgaggaagtagccctggtagcgggcgcgttcgcggggcgggaccaggtccccgatgatcgccagggccagcgagaacaggccgccggcgcccaggccctgcaccgcgcggaagaccgcgagctggtacatcgaggtggcgaacgagcaggccgcggacccgaccacgaagatcgtgatggcggtgacgaagaaccgcttccggccgtagatgtcggagagcttgccgtacagcggggtgctgatcgtcgcggtgatcaggtacgcggtggtcacccacgcctgcaggctgagcccgtgcaggtcgtcgccgatggtccggatcgccgacgcgacgatggtctggtccagcgcggccaggaacatgccgagcatcaggccggagagcacctgcaggatctggcgatggctgagcggcggcgcgccgccggtggcactcattcggcttactcctcgcgataacggttcctgcatcgataccgaggagctggggccggaggttaccggctaagcggggaccgttttccgcttcgcggacccggcgtacgcattcccggctccaagggatccgccagtcaggactcaggaatcactcagctttcgctgagccggtccaacgcggcctcccgcaggctcgcgaatcttcgcaagctaagaggagtccgatgaaatcccatctcgcccgatggtcgctggccgcgggggtgactctcgcggtgatcgcgccgctcgcggggagcgccgccgccaccgtgatcgccccgccgaccccgagggacggccggctcacccaggtcggcccgatcgccgagcacggcttcccggcctggtaccgggacagcaccggcgcccggctggagccctgcaccaccctcgacgacccgctctgtgccgtgctgccgaccgaggtccccaacgcggacctgccggtctcctacccggacaacttcccgggcgagttcttctaccagctcgccgacgcgaccctgacgctcaccgacgggaccaaggccaccatcggcctgaacgtcgagggcgcctgggccaacaacgcggtgatcccgggcgaccagatggtcttcggccgggtccggatccgcttcgcggcggcggccggccgccggttccggatcacccatccgtacggcatcgacgacctgaccgcggacgacaagggcgtccggatgaccgaggacgccggcgccatccccggcgcgttcggcagcgtgctcaacggccgggtcggcccgttcctcaagtgggacccggcggtcgcgccggccgccccgatcggctacatcggcgacccgggcgtcacccatccggtggtgggcagcccgtacggcaccaacttcgtccggatcgaggagctcgacccgcagtccggcgcggtgctcggccaggtcggcttcaccgaccagttcaccgtgcagggccggtacgccaccaacgcgggcgtcgacgtcgaccaggccaccttcaccagtggcccggacggctccggcgcggtcgaggtgtacgccaccagcgagcccggtcaggcgatcgagatcgccgcgaacccggcgctcggcatccgcggcacccggctgcgcggctccggcaacggtcgttactacggccgcttcgcggtggccgggccgctgccggccggtgcctcggtggagatcgtcaacgcctcggaccggccggtcgcccgcaagacccgcagactggtcgacgtcgtgcagatcaccgaggcgaggtacgacgccgacgcgcagaccctgaccgtggccgccaccagcagcgaccgggacgcccagccaggcgtgctgagcgtggccgggtacggcccgatcaccggccagccgttcaccggcgtgctggcggcgcccgccacggtcaccgtcaactcgtccagcggcggcgcggcgaccgcctcgctgctcggctcgggcgcggggttcggcccggcccgtccggtggccggggccaccacggacgcctcgccggtcgccggccaggtcgtgaaactcgacggcaccggctcgaccggggagatcgacgcgtacagctggacccagaccgcgggcccggcggtcaccctgaccggttcggcgaccgccaccgcgtcgttcgtcgcggcgacgcccggcacctacaccttctcgctgaccgtgtccgggccgggcgggcagagcctgcccaccgccgtcacggtgaccgtggtcccggccgccaagccggtggcggtggccggcgccgaccagacggtgctgcgcggcaaggtggtcgcgctggacggcagcgcgtcgaccggggccgagtcgtacagctggaagcagatctccgggccggcggtgaccctggccggggcgtcgtcggcgaagccgaccttcaccttcccggcgcaggcgctgcccgccgcgcccgggccgaacgccggtttcgtcttcgacaacgacccggtggtgctggagctcaccgcgaccaacccgaacgggacggccaccagccggatcaccgtccggccgcaggccgagacgttcccgggcggggtcaccgcgcggtaccggaccggcaacaacgagtggcggatcaccggcaccagcagcctgatcgcgggtcagcggatcaccgcggtgctcggtgacacgctcaccggccgggtgatcggcacctcgccggtcgacgcggcgggtgcgtacagcatccgggtcaccgggccggcgcccggcgcggtccggacgatcagcgtggtcaccacggtcggcggccgccagctggcggtcgcggtgaccatcaccaactgagtcaccggacgcgacaccgcggcggcggtcccctgagcaggtctcaggaggccgccgcctgctgtttgcgcaggtagatggcggtggccgcggacacctgggcggccaccgcgtcgcggatcagcgaggcggcgtggccgaccttgccgtccgggcactcgcgcagcagatgcgcgtgcaccagcgcgtcgacgcagcccagcacctcggtgaccggctgcccggtgagcccggccagttcggccgcgcccaggtcgccgagcaccgcgcagacccgcagcagctcccaggccagcggcggcatccactcggtgcgccgccgggccacctgcatggccaccgcgccggccacctcggccggccgccgggccaccgccaccagggccgggatgccaccggtcagggccggcaccgccggatcgccgagcggctccagctctgccggggtgagcgggctgagccgcatcaccaccggcgtgcccagcccggccagcgggcgcccggacagctgggacgggtagtcgtaggtcagcacgatccgcaggcccgggcagtgcccgctgagccaggcgagctcggcgacgctggccgcgtccagatcccgggcgtcgtcgacggccaggtagacggtctccggccggtcgaaggtctgcccgatcagctccaggtcggcctggcacagcggctggtcgggccgggcccggtcgaccgccccgatcgcctcgggcgccgcgtccagcgcggtcagcgcgctgcgcagccaggacaggcggagcacgccgacggccgggccggcgtcgccgatgccgatccgcccgggggtgtgccggcccagttcggccaggaacgccgacttgccggagccgctcggcccgacgaagtgcaccaccggcggggtgcccggctcgaccatcagccggatctcggtgagccggcccaggaaccgctcccggagcgccggctgcggtggccgggcgaccggcggcgccggctgcggcgtcggggcgaccggcggaaccgggggtggcgtcggggcgaccggcggaaccgaggccggcacgggcgtggtggccgcgggcggagccggaaccggggccgtttcgcggccggccagcaccgactgcttgatcatggcgagctcggcggacggggccaccccgagctcgctgttgagtacctggcggcagcgctcgaagatgcgcagcgcgtcgtccgggcggcccatcgccaccgcggcggtcatcgcggcgtggtagccggactccaggaacgggttcagctcgatcgcctcgtgggccagccgcagcgaccgcggggcgtcctcggcgagcgccgcggcggccagccggagcagcgcgttgaccgcggcgaccgagacctcggcgcgcaccggctcggcccagtcggcgtacgggtcctcggggaacggcaggtgccgggccagctccaggatctgctggtgcacggccaggtcgtcgggtccgagcgagtccagccggcggaccaggtgccgcaggtcggccaggtcgagcccggcccgcgcggtgtcgaacaggtagccgccggaacgggtgacgatgaaccagctggccggcccgccctgcggctgcagccggcggcggatcaccgagacgtagtgctccagcgcgccggcgtggttgcccggcaggtcctcgccccacaccgcgtcggccagggcgtccttggactggatccggtcgtgccgggcggccagcacggcgagcacctggcgggcgcggcggggcagctcgccggcgggcaggacgccgccgtcaccgtcgacgacggtgagttgtcccagcacgctgacctgtagccacacgttgtggtgatcgcccgaagcgggccggagttgagaaacggacctcagtaaggccaacggaacccctcagcggccgactctacgtttcgcatccctgtgcaaaccctgggaagaagaggtgtgggatgggccgcgggaatctgagtcggcgcgacgtgctcaagggcgcgctcgcgctcggtggcggtggactgatcgtgatgaccgccggcggtgaggtggtggcggcgtcgagtcagctcgccgccaagaacatgccgaccccgttcacgaacatgttccgccgcccgccggtgctgatgccggccgaggagggcgtggacgacatgggcccgtaccagaagtaccggctcacccagaagctcggccgggccagcatcgtgcccggtctgaccaccacgatcgccggttacaacgggatcttccccggccccaccatgcgggtccggcagggcacccggaccgaggtccggatctgcaacgcgctctccgacgtgaacaagctcaacggacggccgttcagcacggtcacccacatgcacggctccgcctccctgccgcagtacgacggttacgccaacgatcagacgaaacccggtcaggtgaagacctacaagtacccgaactggcagcagggccggaccctctggtaccacgaccacaaccacggggacaccgcgcagaacgtgtactccggcctggccgcccagtatcacctgaaagacccgtacgagacggcgcagttgccgcaggacgagttcgacgtgccgctgatcgtcagcgacgtggcgttcaacgcggacggctcggtcgccttcgtgccggagggcaactccggcttcatgggcgacatcatcatggtcaacggggtgccgtggccgaagatgaaggtcaagccccgggtgtaccggttccgggtgttggccgccaccatctcccggtcgttccggttcgcgctgagcaccggcgacccgttctacatcgtaggcaacgacgccggcatgacgcccaaggtgaacgcggtgcagtcctggcggcagggcggggccgagcggtacgaggtgctgatcgacttccggaagtacaagccgggcaccaaggtcgacctgcagaacctgagcaacaagaacaacgtcgacttcgccaacaccggcaaggtgatgcagttcgaggtggtcgcggacagtgggccggccgacacgtacaagatcccctcgactctcgacctcggtccgcagcccttcgcgaaccgcggggcgatcgaggtcaacaagctgaagccggagatggccaccgcgcggcgccggctgcgggtggagcgcaagcagggcgagtggaccgtcaacggggagacctgggcggacgtcgaggcctccaacttcacccggatcctgggcaaccccaagccgtacgacgtggagatctgggacctggtcaacgagtcgggcggctggtaccactcgttccacatccacctgatcgacgcccagatcatcgggcgcaacaccaccgccgacggtaaggcgcatccctgggagggtggcggcaaggacgtcttctacctgggcgagaacgagacggtcaccgcgctgatgcagttcacgacgggggacggcaacgccggtggccggtacatgacgcactgtcacaacctggtgcacgaggacagtgacatgatgatccagttcgcggtcggtgacctggagacgaacaacccgatcatgatggatccgccgcggccggagaccgaggccgagatgcccgcggtctacgctccgagctacccgctgggcacctgatggtcgccaagctccgcggaccggcgctcagcctgctgctggtgctcgccgcgttcacggtcgcggcctggtcgggcggctggttcgccacccggccgcccgggtcgccggccgcggccgcggtgatcagcgacgacgccggcgacgagatcgccaccaccaccttcgacgggccgatggtgcgcaagcgggcggcgctcgccgtgcacccggccaagggcgccgaccgggcgcacatcgcggccgaactccggacggcggcgacggccgcggggatcggtgagctgaccgacgcgacgttcgccgtgttcagcgccgacctgctgcgatatctggtgccggaggtgaccctggtgctgcccgaggggatcacggtgcagcgggccgaggcgttcatgcgggaccaccagccggacgacgtggcgttctacgtcgcgcagacggtgctggtgcacgacgtgaccttcgcggtggtgaccggcggggtggcgccggccgaggcgcagcggcgggaggacgccgagggcatcctcagcgactcgctgaaccactacgtgaccaccgtgcagccggccgggctgaccgtgcgctacttcggggcgctgctcagcgacggtcagatcggggcggtgcgcacggcgatggcccgggcggccgggacgacggcggatcgggtgagtgtggcggccagcgagccgggggccggcgtggacctgtccggcggcctgcccgacctcgacgcacaggcggagcatcacggacattaaccccatgatgtcgtacggcggcaatcggatgttgatcttgatagatcggcttcagctcggctaaagctggacctcagccgcccatcccaatatgtacgaaattcccgtgctaaacgggcatcgttccgggagggcaagcttgctgaagccgaagctccgttccgtcggcgtcgcgctggcggtgctggtcgccgtgatcatcacggcgccggccgccgccgtggccgccccgatcggccaggggttcaccgtgaccccggccgacctggcctacatcctgcagcaaatcaagatcgctgaggcgcacgtggccggcaccaccagcgcgaccggaccgtgcggcgcgctggcgatcggcccgctgcagccgttcggcctgcgcacggtcgacggctcgtgcaaccacctcggcaaaggtcaggagctcttcggcgcggccgaccgcagctttccgcgactcgtcccggcccagctgcgccccggctacaccggccggaacgcgaccgacgccgccccgcggcagatcagcaacctgatcgccgaccagagccgggcgaatccggcggcggtcgcggcggcccacggcggcgacccggcggccggcatcccgaacgtcaccccggacgccggcctgtccgcgccgtacaactcctggttcaccctcttcgggcagttcttcgaccacggcgtcgaccagacggtcaagggcggcggcgcggtgatcatcccgctcgccgccgacgacccgctggtgatcagcgagaaactgccgcccggcctgcggttcatgatcctctcccgggccgccggggccggcgacgccaagaacaccgacacgccgtacgtcgacaactcgcagacctactcgtcgcacgccgcccaccaggtcttcttgcgcgagtacgacgagcgcgcccaggacaccggccggctgctcagcggtgccgccggtggcctgcccacctgggacgacgtgcggcgccaggcccgcgacgtgctcggcctgcagctgagcgacacggacgtgctgaacgtgccggcggtgctggccgacgcgtacggcgacttcgtccccgggccggcccgcggcctgccgcaatacgtgaccgccagcggactggtcgagggggacaccgcggccccggtcgccgtgccggcgaacgtgctgcatttcgacacgcccttcctggccgacatcgcgcacgccgccgacccgtcccagccgggctacgacccggccctgctcggccggcactacgtggccggggacggccgggtcaacgagaacatcgggctgaccgcgatccaccagatcttccagtccgagcacaaccgcctggtcggcgacatccagcgggtcgccgccgaggccgggaccggcgccgagtggaccggtgagcggctcttccagggcgcccggttcatcaacgagatggaataccagcacctggtcttcgaggagttcgcccgcaagatccagccggcgatcgacccgttcgccggctaccaggagcagatcgacccggcgatcaccgcggaattcgcgcacgccgtctaccgcttcggccactcgatgctgaccgagaccatcgcccgcaccaccgcggacggcggcgacgactcgatcccgctgctcgacggcttcctcaacccggacgcgttcaccgaccacgggacgctcagcccggaacaggccgtcggcgagctggtcgacgggatggccgcgcagaccggtaacgagatcgacgagttcgtcaccgacacgctgcgcaacaagctgctcgggctgcccagcgacctggccgcgatcaacatcgcccggggccggtccgaagccatgccgtcgctcaacgccttccggcgcggcgtgcggctcaccccgtacgtcaactgggccgacttcggcgaacacctgcgacaccccgcgtcgctggtcaacttcatcgccgcgtacggcaacgacccgtcgatccgggcggcggacaccgtccccgcgaagcgggcggccgcccaggcgttgctgaactcgccggacttcctctacgccccggccgccaccaccggcgtcgacgacatcgacctgtggatcggcgggctcgccgaagccgccgtcccgttcggcggactgctcggcagcaccttcaaccacgtgttcgaacggcagctgaccgccctgcagaacggcgaccgcctctactacctggcccggaccgccgggatgaacctgcgcacccagctcgaaggcaacaccttcgccgagctgatcatgcggaacagcaccgtccgggggctgcgggcggacaccttcgccaccaccgactgcacctacgacctgacccggctcaccttcgccggcagccgcgtcctcgacgacccggcctccgcctgcgacgaatccgcccagctgctgcgcctgccggacggcaccgtcacgcagcgcgcgaaatccaaggcccagtccctctggctcggcggcgaggacaccgaccgggtcggcggcggcatcgacgacgacaccgtgtggggcgccgagggcgacgacgttctcgacggcggcagcggcaacgacgtgctgatcggcggcgagggcgacgacatcctcaccgacccggccggcaacgacatgccccgcggcggccccggcgacgacgccatcgacgccggccccggcaccgacgtggtgctcggcggcgacggccacgacttcaccgacggcggcgccaacggtgacgagaccttcgccggtgaaggcgacgacctgatctacgccggcgacggcgccgacaccgcgcagggcgacgccggcgacgactggatcgaaggcggtgactccgccgacacgctgcacggcgacagcgccaacccgttccccctcgacgacgccaaccgggccggcaacgacgtgctgctcggcgagggtggcgacgacgactacgacatggagggcggcgacgacatcggcgtccagggacccggcgtcgaccgctaccggggcggcaccggatacgactggtccgtcgccgacccggccgacccccagccgatcgacgccgacctgctgcgcaacctggccgaaccggtcaccgccgacacccaggaccgctaccgcgaggtcgaagcgctctccggcggcgccggcaacgacgtcctccgcggcgacgacgtggtgccgacgcagtcgccactgctcggctgcgacgcgctggacgccgccggaatcgcccggatccccggactcgaccggatcgtgccggcgccgctcaccccgcagtcggtggtcaccaaccgcaccgggcagccctgtcacctgcagggcaacgtctggggagcgggcaacatcctgctcggcggccccggcgacgacacgctgcaggggcgcggcggcgacgacgtcatcgacggcgaccgctacctcacggtccggctcgtggtccgcgacgccgacgggcacgagatccgctcggcgcactcgatgcgcgacctcgaagccgacgtcctcaccggcaccatcaaggtcaaggacatcgccttcgtccgcgagatcgcgacggcgcccggcgtcgacacggccgtgtacagcggcgaccgggccgcctacgcgatcacgccggtgaccggcggcctgcaggtgtccgggccggacggcaccgacctggtccgcaacgtcgaacggctgcagttcggcgaccagaccgtggacgtgaccgggctccaggcgtacctcggagtgtcggcgttcgccggggcgggggcggcaaccgtgctgatcaccgtgccggagggggcgtcggtgaacgggctgactctggagcggacgtccagcgagggggtggtgcggacgtcgttggcggcttccgcccgcagtgtggtggtggccgggttgacggcgggggtggcttacacgttccgggtgcgggcggagagcgctgcggggagtggcgcgttcagtgcgccgtcggatccggtgacgccggatgccgcgtccgcggacccgtcgggggcgggtgctccggggaccggtggtcctacgaccgctcctggcacggctgttcctacgatcgcggtgccgacgaccgctcctggggtcggtactcccactgtcgccgttcccacggttgccgttcctacgattgccgctcctacggtcgcgcctccggcgccgacgaatcccgcgcggccggtgatcccggtggctccggacgctccgcggatcggcctggcgaccgccggcgacgagagtgcgaccgtccaatggacaaagccggtcaatgatggcggaagcccgatttacgggtatgaagttcaagccctcgatgaccagaccggcatcgtcgtgggcgtggacgccgccgacgccaacgccacctccctcaccatgaccggcctcaccaacggccagccctacgctttctgggtccgcgccgtgaacgccgccggagccagcgacttctccgccatctccaaccgcgtgatccccggtcccgccggcggtgccggcgccccgtcgggcggttcgtccggcggtgcgggttcctcgggcggtgccggttcgtccggcggtgccggttcgtccggcggtgcgggttcgtcgggcggctcgggctcggcgggtggttccgccggcggatcctccggtggctcttccggtggctcttccggcgggtcgtcgggtggcggcacgcccggtggttccggaacgacgcctccgtcgaccggtcccggcacgccggccggcccggccgacccgtcgacgaccgagcgcaccgttcccggagctgcccggatcggcaccccggtcgccggcaacgcgctggccgtggttcgctggaccgccccggtcagcaacggcggctcgccgatcctgcgctacgagatccgtgtcctggactccaggaatcggcaggtcggaacgctccgggacgctgacgccaccgccgccgcccagacagtgaagtccctggtgaacggcacttcgtaccacttccgggtccgagccgtgaacgaactcggcgccggcccgtggtccggatcgagcggcgcggtcgtcccgcggaccaccccgcccgccccgcgctcactgaccgccacacccggaaaggcgggtggcgccggcaccaccgtcctgcgctggacgccgccgtcctccacggggggtgccccgatcaccgggtaccgcctcaccgtccagcgtctgaccggcaaggggaagcccaccggcgcctcggtgacgttcgccttctccggctccgtcaggtcggcgacgttcaccgcccctggcggtgtcccggccggaacccggtaccgcttcaccctgcgcgcggtgaacaccgccggccagggtcaggcccgctcggtcctcggttcggtccgctgacccggcgcattacgcagaatcaccgtgaggccggcacccgcaccggggccggcctcgcggcctgagcgacccccttcgccaaccatcagaatgccccgacaccgtcggcagcgctgcgccggcgcctccgccaccaccgaagcgaactccaaggtcaactccaacacccggtcccgggcagcccgcgggcaccaagggcgcggtggccggagcattcagcgggtttccgtgaccaaccgcggatgtggaagggtgcggcgattgtcctggacgcgccagcggccaaatcgccgtgcccactcgcccccgatgggcgacgatcggttatcggccgcagcgcatgacatcaagatcttcgctatcgatcttcgatgttggtttcagcgtcgttccccagccctgtcgcgtggcggagaaggcaatgtcgctcgtcgaggaggcggccttccgcggccggggagaatggcggcccgggaagccccgagccgccatgatcgccaccgtgggaactattccggaacccgccggtaagcgccgtcgctcgcgctggtcgccatcgatgcgtaggcgcgcagcgccgccgaaaccggccgctgacggtcgaccggcgagtacggcttgggccgccgttcctcctggtgccgccgctgcgccagcgtctcgtcgtcgacgttcagggtgatgctccgccccgggatgtcgatcgtgatctcgtcgccggtctggaccagtgcgatcagtccgccgccggccgcttccggggagacgtggccgatggacaggccggaggtgccgccggagaagcggccgtcggtgatcagcgcgcacgccttgccgaggccgcggcccttgaggaaggacgtcgggtacagcatctcctgcatgccgggaccgccacgcggaccctcgtagcggatgatcacgacgtcgccggcgacgacctccttgccgaggatgccggtgaccgcgtcgtcctgggattcgtagacccgggccgggccggtgaatttccagatggactcgtcgacgccggcggtcttgacgacgcagccgtccggggcgaggttgccgaagaggatggcgaggccgccgtcgacggtgtacgcgtgttcgacggaccggatgcagcccgcggccgcgtcggtgtccagggtggcccagcggttggtggtgctgaacggctcggtggtgcgcaccccgccgggggcggcgtggaacagctccagcgcctcgggggtgggcgacccgccgcggatgtcccagtcggtgagccaggcgtccagggacggagcgtgcacggcgcggacgttcgtcttcagggagccgccgcggtgcagctcgccgagcagcgcggggatgccaccggcccggtgcacgtcctccatgtggtatttcgggctgttcggtgcgaccttcgacaggcagggcacccgacgggagatcgcgtcgatgtccgcgacgctgaagtcgatctccgcctcccgggcggcggccagcaggtgcagcaccgtgttggtggagccgcccatcgccacgtccagcgcgaccgcgttctcgaacgcgtcccggctggcgatcgagcggggcagcaccgacgcgtcgtccttctcgtagtactccttggcgatctgcacgatcagccggccggcctcggtgaacagcgccttgcgtgaggcgtgcgtggccagcgtggagccgttgccgggcagggacaggccgatcgcctcggtcaggcagttcatcgagttggcggtgaacatgccggagcaagagccgcaggtcgggcaggccgaccgctcgatggtgtccagctgggcgtcggtgacgttgtcgttggcggcggcgctcatcgcgtcgaccaggtccagcttctcgtggacgatgccctcgatggcgaccgtcttgccggcctccatcgggccaccggagacgaacaccgtggggatgttgagccgcagcgcggcgatcagcatgccgggggtgatcttgtcgcagttcgagatgcagaccagggcgtcggcgcagtgcgcgttcaccatgtactccaccgcgtcggcgatcagctcgcggctgggcagcgagtagagcatgccgccgtgacccatcgcgatgccgtcgtcgaccgcgatcgtgttgaactcgcggccgacgccgccggccgcggcgatcgactcggcgaccaggccgccgaggtccttgaggtgcacatgcccgggtacgaactgggtgtagctgttggcgatggcgacgatcggcttgccgaagtcgtcgtcggtcatgccggtggcgcgccacagggcgcgggcaccggccatcgtccgaccgtgggtcgaggtccgggagcgcagctcaggcatttccccatagtgccaccgagcagggccgcgacggccagcgacgtccacagcgcgggacgcgaacccttccgtgatcgatgaagatccggcagagtggcagcgtgcactcaccgtccggtatggagctggcgggcctcgcgggcctgctggccgccgtcccggcggtcgccctgctcgggcgctccggccgccgccacaccggggacgcccgccgggcccacctgctgctcgccggcggtggcgcgctgatcaccgcggccgccctggccgggatggccaccgcgctgctcaccgagcaccaccacggcctggccagccggacgctggccacgctgatggcgatcggcatgggatgcggcacgctgaccctgctggccggcacggtggcgctgcccggcgcggcccgcggcccggccgccgcgctgcggcacgtgctggacgggctggtgatcgcggccgcggtctggttcgtcggctgggtgctgatcgtccgcccgacccacctgctgggcgccgccacgccctacgagtgcgtcgcggtgatcctgccggccgggctggcggtggccggcctgggcctgaccggggtgctggccctgcacgcgcaccggccgcggcggcacagcgtgtgggtgggcgccggggtgagcctgaccgccgcggcctcggccggggtgtccagcggtgtctgccggcggggtgacgagctggtgctgagctcggtgctgctgctcagcgccgggctgttcctgatcgccggcgcggtgcgggccgccgaccggccggtgcgggtgaccggcgacgtgctggagcgcggcggggcgtacgcggtggttccgatgatcggcgtggtcggcgcgctcggctatcacctgacgcgcggcgggacgctcgacgcgtacggctatttcggcctcagcgtggagggcctggccctggtcgcacggcagttcctggccctggacgacgtccggcgctacacggtccagctgcgccagcgggagaagcacttccgcgacctggcgcacaccgatccgctgaccggcctggcgaaccggcgcggcctgcagctggcgctccgggagggcgaccggtgcagagccctgatcggcatcgacatggacggcttcaagacggtcaacgacctgcgcgggcacgacgtcggtgacgcggtgctggccgaggtcggcgcccggctcaagcgcaacctgctgaccggtgacgtggcggcccggctgggcggcgacgagttcgcggtgctgatgcgcgccgagccggaggaggcggtgctggccgcgcaccggctgctggccgtgctgggcgagccctacgaggtggacggcggtcagatcttcctgtccgcgagcgtcggcgtggccagcaccggtgagctgctgcacgacgccgacctggcgctgcgctacgccaagcagcgcggcaagaaccgggtcgagcagtaccaggcggggtacgacgagctgctgcgccggcgcggcacgctgaccggcgagctgcgccacgcgatcgaccgcgatcagctgcggctggtcttccaaccggtggtggcgttgccgtcgatgcgcccggtgggcgccgaggcgctgctccgctggacgcacccggagctgggaccggtccgcccggacgagttcatcccggtggccgaggagtccgggttgatcaaccggatcggcgcctgggtgctggagaacgcctgccggcagctcgccgactggctggccgccgggcacgacatctggatgtcggtgaacctgtcgcccaaggaactgcacaacgccgactacgccgggcaggtcgccgagatcctggccgacctgggtgtcccgccgcagcggctggtgctggaggtgaccgagcacgcggtcgccaccgacatggaggagctggtccgccggctggccgagctgcgcgcgaccggggtgcggatcgcgctggacgacttcggtgccggctattcgtcgctcacccagctgcgcaccctgccggtggacatcctgaagatcgaccacgcgctggtggccgagccggagtcgcggaccggcacggcggcgccgctggtcgacgtggtggtccggctggggcaccggctggggctggaggtgctggccgaggggatcggcacgccggcccagcgcgaggtggtggaggaggccggctgccggctcggccagggctcgctgttcggctggggggtgccggccgagcacttcgagtcgcggctgcgcaccatgcggccgagcggtccgcggccactgccggcgccgcgttccggcccgccgaagaatgcggcggcgcgcagccaggtggtccgcctcggcccgggaatgcggcagctcagagcgttgctgccgaccgatccggagttcgcggcgcgggtcgccgatcaactcgatgatcaaaatgtgggatcagttgactcaggccgtgagatggggcaaggttagtcgcatgtgcttcgcgtcccgagtacttctctaagcgcaccactcctcacgaggagggtgcgctaggtcccgtgcattcgcacgaggaccttttttgttgctccagtaccggacgccaaacccgaaaaggtctaatgccatgacgagacccacgcccgagtccctcgcccaccgagccacgccggccaccgtcgcggcggccgtgaacaccgccccggcctcgaccgctccggtagcgaccacgggcgccggcgcgctcgtccggtcgctcgaggcgctcggcgtcgaggtcgcgttcggcattccgggcggggcgatcctgccggcctacgacccgctgttcgactcgaaggtccggcacatcctggtccggcacgagcagggcgcgggccacgcggcgaccggttacgcgcaggccaccggcaaggtcggggtgtgcatcgcgaccagcggcccgggtgcgacgaacctggtcaccccgatcgccgacgcgtacatggactcggtcccgatcgtcgcgatcaccggccaggtggcccgcccgtcgatcggcaccgacgccttccaggaggcggacatccagggcatcacgctgccgatcaccaagcacaacttcctcgtgcagaccgccgaggagctgccccggatcgtggccgaggcgttccacctggcggccaccggccgacccggcccggtcctggtcgacatccccaaggacgtgctgcagcagcagaccacgttcacctggccgccgaccctggacctgcccggttaccggccgaccctgcacccgcacggcaagcagatccgtgaggcggcccggctgatcgcccaggccaagcgcccggtgctctatgtcggcggcggcgtgctcaaggccggcgccaccgacgggctgcgcaagctggccgagctgaccggcatgccggtggtcaccacgctgatggcgctcggcgcgttccccgactcgcacccgcagcacctgggcatgcccggcatgcacggtacggtgcctgcggtctacgccctgcagaaggcggacctgctggtcaccctgggcgcccggttcgacgaccgggtgaccggcaagctggactcgttcgcgccggacgccaaggtggtgcacgccgacatcgacccggccgagatcggcaagaaccggcacgccgacgtcccgatcgtcggcgacgcccggcacgtgatcgacgagctgatcgccgcggtgtcggccaccgccggcggcgtcgagcagtacccggcctggtgggccacgctcaacgacatccgcgagcggtacccgctgggttacgacgagccgaccgacggcaccctcgccccgcagtacgtgatcgagcggatcggcgcgctggtcggccccgacgcgatctactgcgccggcgtcggccagcaccagatgtgggcgtctcagttcatccggtacgagaagccgggcacctggctcaactcgggcggcgccggcaccatgggctacgcggtgccggccgcgatgggcgccaaggtggcccagccggacacccaggtctgggcgatcgacggcgacggctgcttccagatgaccaaccaggagctcgccacctgcgcgctggagggcatcccgatcaaggtcgccgtgatcaacaacggcaacctgggcatggtccggcagtggcagaccctgttctacgacggccgctactcgaacaccgagctgggcacccacaagcaccgcatcccggacttcgtgaagctggccgaggcgctcggctgcatcggcctgcgctgcgagtcgaaggacgacgtcgacaaggtcatccagcaggccatggagatcaacgacgcgccggtggtcatcgacttcacggtcggcaaggacgccatggtctggccgatggtggcggccggcaccagcaacgacgagatcatgttcgcccgggacgtgcgtcccacgttcgaagaggacgacctctgatgtccaacaagcacacgctgagcgtgctggtggagaacaagcccggtgtgctggcccgggtcagcggcctgttctcccgacgcagtttcaacatcgactccctggcggtcggcgagacggagaacccggacgtcagccgcatcacgatcgtggtggacgccgagtcgtctccgctggagcaggtcacgaagcagctcaacaagctggtgaacgtcctgaagatcgtggagctggacccggcgcagtcggtccagcgcgaactcctgctggtcaaggtgcgcgccgaccgggcgcagcgcggccaggtgctggagaccgtcgagctgttccgggcgcgcgtgatcgacgtcgctccggacaccctgacgatcgaggccaccggcaaccccgacaaactggatgcgttgctgcgcgacctcgagccgtacggcatcaaggagatggtgcagtcgggcctcgtggccatcggccggggatcccgctccatcaccacgggcccagccctgcgtgccgcctgatttttcaagaccagagaagaaggaagtcatgaccgccgaagtgttctacgacgacgacgccgacctgtcgatcatccagggcaagaaggtcgccgtcatcggctacggcagccagggccacgcccactcgctgtcgctgcgcgactcgggtgtcgaggtcgtcgtcggcctgcaggagggttccaagagccgtccgaaggccgaggagcagggcctgaccgtgaagactccggccgaggcgtccgcctgggccgacgtgatcatggtgctggcgccggacaccgcccagcgcaagatctacgccgagtcgatcgccccgcacctgaccgccggcaaggcgctgttcttcggccacggcctgaacatccgcttcgagctgatcaagcccccggccgacgtcaccgtcgcgatggtcgccccgaagggccccggccacctggtccgccgccagtacgtcgacggcaagggcgtccccgccctgatcgcggtcgagcaggacccggacggcaacggccaggcgctcgccctgtcgtacgcgaaggcgatcggcggcacccgcgccggcgtcatcaagacgacgttcaaggaggagaccgagaccgacctcttcggcgagcaggccgtcctctgcggcggcaccgcggccctggtccagaccggtttcgaggtgctcaccgaggccggttacgccccggagatcgcctacttcgagtgcctgcacgagctgaagctgatcgtcgacctgatgtacgagggcggcatctcccggatgcgctacagcgtctcggacaccgccgagttcggcgactacgtctccggcccgcgggtgatcaacgcggagaccaagcaggagatgaagcggatcctcgccgacatccagtccggcgagttcacccgccacctgatcgccgacgacgaggcgggcggcccggagctcaagaagtaccgcgagcagggcgcgcagcacccgatcgaggtcaccggcaagaagctccgcgacatgatgagctgggtggacaggccgatcaccgagacggcatagtcggacgaaagggcgcctggtcgattgcggccaggcgctttttcctgcccgaaatcaacgtcgaattcctcatatacgcaggtccagcggggtgcagatcgcatgctcccgcgcgggccgggccacggcgatctggccgctggcgcgtccacaacgatcaccgcggcccttcactgcccgtgggtggtcaccgaaaacccggtgcggctcgaacggcgcacggcgggtcgcggaaaacgccgtaccatctaatctcgtctatgccagcgagttgggtggaggcttggtgacttccattgtcctggtaaccgaggaattggccccggccgcaatcgatgttctcgccacggatttcgaggtccgtgcggtggacggcacggatcggtcggtgctgctcgacgccctgcgagaggccgaggcggtgatcgtccggagtgcgacgcggatcgatgccgaggccctggaacacggtccgcatctgcgtgtggtggcgcgcgccggcgtggggctggacaacgtcgacatcgccgccgcgaccgctcacggggtgatggtggtcaacgcgccgaccagcaacatcatctcggcggcggagcaggcggtggccctgctgctgtgcaccgcccggcacaccgcgaccgccagcgccgccctcaaggcgggtcggtggcagcgcgcgaagttcaccggggtggaggtgttcggcaagaccgtcggcgtggtcggtctgggccggatcggcgtgctggtggcccagcggatggccgcgttcggcaccaccgtgatcgcctacgacccgtatgtgcagccggcccgcgccgcgcagctcggcgtccgcctggtcaccctggaggagctcctccgggagagtgatttcgtctcggtgcacctgccccgcactcccgagacgctggggctgatcggcgagaaggaactcgccacggtcaagcccggcgtgcggatcgtgaacgcggcccgcggcggcctggtcgacgagcgcgcgctggccgacgcgatcgcggacggccgggtggccggcgccggcctggacgtcttcgagaccgaaccgctcaccacctccccgctgttcggcttcgacagcgtgacggtcaccccgcacctgggcgcgtccacggccgaggcgcaggacaaggccgggctggcggtggcgcagagcgtgcggctggcgctgcgcggcgagttcgtcccggaggcggtcaacgtgcgggccggcggggcggtcgacgaggacgtgcgcccgctgctgccgctggccgagaagctgggccgggtgttcaccgcggtggccggtggggtggccgcccgggtcaccgtggacgtgcgcggcgaggtggccacgcacgacgtcgaggtgctgcagctggccaccatgaagggcctgttcgcctcggtggtggccgagcgggtcacctacgtgaacgcgccgcggctggccgccgatcggggagtggcggtggagctggcgacgtcggaggacgccggcgagcacgccgccctgatcgtggtgcgcggcgcgctggccgacgggcggaccatcgcggtggccggggccggcacgaagctggtcggggtggacgggttcgagctggacctgccggccgacggggtgctgctgttcgtccgctaccgggaccggcccggcgtggtcggccggatcggcaccggcctgggcgcggccgggctgaacatcgcggcgatgcaggtggctcgggaggcggccggcggggaggcgctgatggtgctgctggtcgactccccggtcgagccggagctgctggcccgggtggcggcttcggtggacgcgagcagtgccgtctcggtggacctgcggggcacctgagcgcgtcgtcgccggtcccggccggcgctgtccgccggcgtttccccgcccctgacgggcgcgccgtcagcggacctgcgtggcgcgcaacggcgggtagaccgtcccgtcctgcaggtcgagcaggtcgaggttgagctcggcggccagccgctcgatcgtctccagcacctggtccgggcagttctcgtcgagccgcatctggatgtggtccgcggcggcgtgcagcggcgcgctcgcccacggcgtgccgggcgccgtcgcgcgcggcccacgatccggataattgctggtcaaagcgtcgtagaaggcgacgacgcgggggtcggccgggcgctgcgggtgcacgccctcggcacaccgcgcattggcggcgcgcacctgttcgggcgccgccgccgggtccatcgcccacaccactaggtcgaaactcaccggcgcatggtgccatcaccggagcccccgggcgcagaaaccgtgggccgacacgcggggatgcgtcttgcgcgtttttggtccgcatcgctagcgttgtccccagccgcacgtctcgggtgggcctgtcttcgggtgacgggattcgccgcgggccgcgcggtcaccttctggcgggaccgagccacgcgtcatcgtcgccacagcccccgtgaccgtttgccgcggtccgggggctgttcgcttccggggtggccgaccgggtcgagagttcaaaagatgggactctcgttccggtgttcgggaatcagcgttaccgtgtgtgttgctgaaccggacgtgggcaggtcagccggagacaggggagtcagacgtgagcgtggcgcggatcgcggtcgtggccggcgacggcatcgggaccgaggtgaccgcgcaggcgcgcaaggtcattgacgccgtcctccccggagtcgactaccaggagtacgacctgggcgcccgcctctaccaccgcaccggcgaggtcctcccgcgggccgtcgaggacgagctggccggccacgacgcgatcctgctcggcgcgatcggcgacccgagcgtcccgccgggcgtcctggagcgcggcctgctgctgaagctgcggttcgacttcgaccagtatgtgaacctccgcccgtcgaagctctggcccggcaccaccagcccgctcgccggggtgaaagccggcgagatcgacatggtcgtggtccgcgagggcaccgagggtctctacgtcggcgccggcggcgtcctgcaccgggacacccccgccgagatcgccaccgaggagagcctgaacacccggcacggcgtcgagcgggtcatccgcgacgcgttccagcgcgcccagcgccgcgaacgccgccacctcacctgggtgcacaagaccaacgtgctcacccacgccggcaacctgtggtcccgcacgttcgccgcggtcgccgcggagtaccccgagatcaccacggagtaccagcacatcgacgcggccagcatgttcatggtcagcaacccgcagcgctacgacgtgatcgtcaccgacaacctgttcggcgacatcctcaccgacatcgccgccgcggtcaccggtggcatcggcatggcggccagcggctcggtcaaccccgagcggaaatacccgtcgaccttcgagccggtgcacggctccgccccggacatcgccggcaagggcatcgccgatccggccgccgcgatcctctccgccgccctgctgctggagcacctgggccggcacgccgaggccgggcgagtaaccgaggcggtcgcggccgaggtcgcgtcccgcacgccgggcgcgccgctgcgtaccgccgaggtcggcgaccgcgtcgccgccgcgctctgagccggctcgccgccgcggtctgagcggattccctccgtacgcccgggttacccgggcgtaaaccccgtgcccgttgttttaacgaccgttcggggtacattcatgggcgcactccgggtgcccctcgcatgcttatttctgcagaaagcaggtccccttgccatgagcggtggtgacaacctcgacttcgagatccgtccgaatcccgcgcccgtaggagacgctgagcgcgccgccctgctggcgaacccggggttcggacggatcttcaccgaccacatggtcaccgtgcgttatgccgacggcaaaggctggtatgagccgcgggtcgaggcccgggcgccgatcccgatggatccggccagtgccgtgctgcactacgcgcaggagatcttcgagggcctgaaggcgtacacgctgcccgacggtggggtcgccatgttccgcccggaggcgaacgccgcccggttcgcccagtcggcggagcggatggccatgccggccctgcccgaggacctgttcctcaagtccctgcacgagatcatctcgatcgaccggcagtggatcccgggcggcgaggacggcagcctctacctgcggccgttcgcctacgccagtgaggtcttcctcggcgtccgcccggcccaggagtacctcttcctggtgatcgcctccccggtcggaccgtatttctccggtggcgtcaagccggtctcggtctgggtcaccccggactacacccgggcggctcccggcggcaccggcgcggccaagtgcggcggcaactacgcagccggcctgtccgcccaggccgaggccatcgagcacggctgcgaccaggtcgtctacctggacgcggtcgaacggaagtacatcgacgagctcggcggcatgaacgtcttcctggtcctcgacgacggcaccctggtcaccccgccgctgaccggcacgatcctgcccggcatcacccgcgactcggtgatcagactggccgagcgcgccggccgccgcgtcgaggagcgggcgatcagcctccaggagtggcgcgacggcgccgcctccggccgcgtccgcgaggccttcgcctgcggtacggcggcggtgatcaccccgatcggcaccatccgcagcctggacggcgacttcaccatcgccgacggcggccccggcgagatcaccatgggtctccgcaaggagttggtcgacatccagcgcggccgcgccgaggacaccttcggctgggtccaccgcgtcttctgacgtcatccaccgggttatcgatccgtacccaccgcttcttatgacggtcggcccacgcgtcttctggcgcgtgggccgaccgctttcttctctccgcgtgatcagccaccgactccaccggctgtgatcgaccttttcgtctgccgccgacgccagtagtgacagccgttaacccctgtcgtgcgactagcctttatgcgtcaagctgtctagcgtcaatgtcatgcccagccaaacgcacgagaccctcatcgagatgttccggggccggccggcgctcgcggcggatgtgctcgaccggacgttgcggatccccgtgccggaattcgacgaggcgctcctggcctccgccgagctcgccgacgtcgcgcccaccgaataccgagccgacgccgtcgtcaccctgagccgggcgggcgtcgcggtgctcgccgtcatcatcgaggtgcagctccgcgtcgaccagcgcaagcgcttgtcctggccggcctacgtgggcaccctctacgcccgggtcggctgcccggtcgcgctgctggtcgtctgcccacaccccaagatcgccacctgggcggcaacggcgatcgccgtcggcccgcccggctcgacggtggccccgatcgcgctcggccccgaacagatacccgtcgtcaccgatcccgacgaggctcgttccagtcccgagctggcagtcatgtccaccctcgcccacctcgcccacatcaccgactccgagcggaccgcgctgctcaacgccacattcaccggactcgacaccatcgaaccgagccgcgccgctctatacactgacctcatgctcgcggtcatgccgcaggcggctcggaagctcctggaggattacatgatcactacggataacccttaccagagcgacttcgcccgccgctacttcgccgcgggtgaggcccggggtgaagcccggggtgaagccaaatccgtcctggctgtcctccatgcacgcggcatcgagacgccggagtcgttccgcgccaagttgatggcctgcaccgacgaggccctgcttgcccggctgatccagcaggcggccactgccgagcagctgggagacctggaccccgttgactgatccggctcctgacgtgcatccgcagatcccgccgtccaccggacgtccgagccatggcgcgcagagcgaggctgagcttgccatgatcgccgcgagtcaccactaccgcagcgacttcgcccgctgccacttcgctgagggctggatcaatggccgggcacaagcccgggcaaagacccgggcacagggcaaggccgagtccattctgaccgtcctcgatgtgcgcgggattgagacgccggagtcgttccgcgagaggttgatggcctgcaccgacgaggccctgctcggccggctgatcaggcaggccagcactgtcgagcagctggacgacctggactcgctggactccctagacgaacccgaaccgtagacgttccgggctcacccgccggatggctcgggcttgccgagcgccaaagcgaggctgtggccgccgccggcgcctttgcagccgccgccagacgcaactggctgcggcctgcgcatatcggcgtgccgccgtcagccacctcgttgcctgaccaccgcgtggcggcgcggttctcagcgggtcgcgttgggaacttcagtcctcgtcgccgcggcggttgcgtttgatctgggctcggcgtttcttctcgccgatgcggcgttcgaccgagccgcgcgtcggtttggtggcgcgccgctggcggggcggggccgcgatcgcctcgcccacccgcatggccaggcgggcctcggcggcctcccggttgcggagttgggagcggtgctcggaggcggtgatcgtcagcaccccgtcgaccaggcggctgcccaggcgttcgacggcccgctccttcaaggcgggcgagagcagcccggaggcgagcaggttccaggacagctccacccgggagtcggtggtgttgacgccctgcccgccgggcccgctggagcgggagaaacgccacgagagctcggcctcggggatggccaggccgggccggatcagcacgtcggccatgacgtccctttcgcagaatgccggtgatcgagtacgcggcaagtctggcacccgtccgctcgatcccgccacggggttatccacggacaccgggcggggtcgccgagacgaacgcggcggacaccgggcggggccgccgggacggcggatgcggggcgcaggagggacggaaccgagcgatacacggcatgatgggtcgggtgacgtcaccatccgcaccggtcgccacgaccgggtatccgtggcctatcgaaaccacgcggctggcgaacggcctccgggtcgtcgtcagcgaggaccggaccgccccggtcgtctgcgtcaatctctggtatgacgtcggctcgcggcacgaaccgcccggtcagaccggtttcgcgcacctcttcgagcatctgatgttcgagggctcgcagcatgtgaagaagaccgagcacatgcggctcgtgcagggcaacggcggttcgctgaacgcgacgacgaacccggaccggacgaactacttcgagagcatgccgtcggagcatctggagctggcgctctggctggaggccgaccggatgggcggcctggttccggcactcacccaggagacgctggacaaccagcgcgaggtggtgaagaacgagcgccgccagcggtatgacaacgtgccgtacggggacgcctggctgcgtctgctgccgctgctctacccgccggggcacccgtatcaccatgccacgatcggctcgatggaggatctgaacgcggccgccctggaaaccttccaggcgttccacgcgcagtattacgcgccgaacaatgcggtgctgacggtcgccggggatgccccgccggccgaggtgttcgcgctggccgagaagtatttcggcgggatcgagccggtgccggggattccgccggcgccgaacgggcatctggccgggccggcgaccgagccggtgcgggagacggtgaccgcggctgttccggcgccgcggatctacctgtcgcaccggacgtatccgttcggcaccgccggctatgacgcgatcaccgtgctggccacggtgctgggcagtggccggggcagccggctctaccagcggctggccgacggcaagcggatcgcgcagccggattacatcgggtcgtacggggtcgatctggcgcacgcgccggctccgctgatcgtgaccgcgaccgcgaaggacggggtgagcgtcgacgagttggaggcgggcctggacgaggtgctgcgcagcctggtcgacgagccggtcaccgaggaggagctgaaccgggccaaggcgctgctgaccaccggctggtggcggcaggtgtccacggtcggcggccgggccgacacgctggggcggtatgcgacgcagttcggtgatccggcgaccgccgggtaccgcctgccggcgtggctggcggtgaccgccgacgatgtcaccgaggcggccgcccgcacgctgcagaaggagtcccgggtcaccctcacctacctgccggagaaggcggaggaggcagcatgagtctcgtcacgacacgccccgagccgggcacggcccgcccgtacgcgttcccgtcggtccgccgggtgaccgcgcacggcggcacggtgatcgccgcgcacctgccgggtcagatgctggccaccgcgatcctgctgctggacgccagcgccgcccgcgagccggcgggccgggagggcaccgcgacggtgctcgccaagtcgctggaggagggcacgagcaagcgcgattccgcggcgtacgcgctggctctggaggggttgggcgccgagctgtccccgtcggtcgactgggacaccttccgggtcggcgtgtcggcgccggccccgcagctgaccggcgcggtccggctggccgccgaggccgcccgcacgccgaagctggatccggcggatgtggcccgggtccgcgacgacgaggtgaccgcgctgcggatggactgggcgcagccgggcccgcgggcggacgccgcgttgcgcggcgacctgttcgccggcgaggggcggtacagccggccgttgcacggtgatccggcctcggtggccgcggtgaccgtcgacgacgtgctcgccttccaccgcgagtggatgctgcggccgggggtgctgctggtcgccggtgacctggacgggctggacctgaccgagctggccgaggccgcgttcgccggcacgtccgggcaggccctggccgtggaggcgccgctgggcctggtggttccggcgaagccgcacgtgatcctggtggaccggccgggctcggtgcagtcgacgctgcgggtcggtcaccgggcgccggagcgggccaccccggactacgtgccgatgacgctgatggccacggtgctgggtggggcgttcacgtcccggctcaatcacctgatccgtgaggtgaagggttacacgtacgggatccgcggctcctatgcgatgacccgccgggcgggccgtttcgaggtggccgccggggtgcagaccgcggtgaccgggccggcgatcgcggacacgctcggcgagatccggcgcacccaggtggacggggtgaccgaggcggagctggcggtcgcccggtcgtggcgggccggtcagctgtcggtggagatgcagacgccgggggcgatcgccggggcgctggccaccctggtggtgcacgggctgccggacgactatttcgagacgctgcgccgggagtatctggaggccaccgtcgagcaggtgtccgcggccgcggcccggcacctggcggtggacgggctgaccctggtggtcgagggcgacggcgagaagatccgggcggaactggcggagttcggcgacctgaccgaagcggcactctgagcccactccggggcgtcacccgccggtgacgtcccggagctggtcacgggtcgatagcgtcggccccatgacgatcaccgaggcgccaccggtcacgaccggacggcgcggagcgacgatcctgttctggctgctgctcacgcccggtctggtctggacggtgatccggctcagcggctgggaggccggtcggctcatccaggtgctgccgttcaccccgtacgtggcagtcggatcgtggttgccggccctgctggcgctgttcttccgccggtgggcggccggcgcggccggcgttctgatcgcggtcgcgctggccgcgtgtgtcctgccgcgcgccctgcccgacctggaccggggcccctcgcacggcgtcacgctgcgggtgatgaccgcgaacctgctgctcggcggtgccgacacgaccgagatcacccagctggtccgggacaacgacgtggcggtgctcgcggtgcaggagttcagcccggcggcgcaggcccggctgaccgaggccgggctggaccggctgctgccctaccattcgctggccgccgagccgggtgccagcggttccgggttgtacgcgcggttcccgctggccgatccggggcagaagcgcaaccacggcgggttcctgcagacgttcgggacgttgcaggcgccgggcgccgccccggtcttcgtcgagtcggtgcacccgctggcgccgtcggcgccgctcaccttccacgcctggcgggtcgacctgcgcgaggagccgcggtccgacggcgacaatccgaaccggatcctgctcggcgatttcaactcgacgctggaccacagcgcgctgcgggacctgatctcgcacgggtaccgggatgccgcggacaccgtcggcgacggactgatcggcacctggggaccgtacgacggcgatatgatccccccggtgatcatcgatcacgttctggtcgacgagcggatcggagtccgtgaggtgtccgtgcacggggtggacaggtcggatcatcgttcggtgatcgccacgctgaccctgccggcggcgtcgtgaacgtcacgatccgtccggtgacgctgaccgacgtgcccgagctgaccgaggtgatcaaggcgagccgggagcacctggcgccctgggagccgatccgtgacgagagtttcttcaccgtcgccggccagtggaagatcctcgacgatctgctgaacgccgggaccggcctgccgcacgtgatcctggtcgacggcgcgatcgccggccgggtgaacctgcagaccgtggtgcgcggcccgttccagtcctgcaccctgggctactgggtggcgccggcgcacggcgggcgcggggtcgcctcgttcgcggtgggcgaggtgctgcggctcgcgttcaccgagtacggcctgcaccgggtggaggcggccaccctgctgcacaacgtgcggtcgcagcgggtgctggcgaagaacggcttcgagcggttcgggatggccccgcgctacctgaacatcgccggcgactggcaggaccactacctgttccagaccgtcgcggaaaactggttggagcagcgcaaggccgagtcctagtctcgggggcatgcacagcagcagcgtgatcacgactacgccggcacgtcccggcgtcgagtcgcgctgactcaccgaccccgggcgatccgcccggggcttcgacacggtgccgtgcgggtcgctccgacccaggagacccgtgatgatcgatcaccgcaagctcggccgtgagctggacctgttcgactccgacccgctgatcggcgccggcctgccgttctggctgccggccggcgccgccgcccgccacgaggtggagtcctacctgcgcgagctggaacgtcgcgccggctatcagcacgtctactcgccggcgatgggcaaacggcagatgtacgagatgtccggccactggtcgcacttcgccgcggacatgttcccgccgatgccggtcggcgacgacgagctggtgctgcggcccagcctgtgcccgcaccacgcgctgatcttcaaggcccgccggcggtcgtaccgggagctgccgctgcggatcgccgagatgggtcagatgtaccgccaggagcggtccggcgtgctcggcggcctgtcccgggtccgcgcgatcgcgctcaacgacgcgcacgtcctctgcgcgccggaacaggccgccgaggaggtcggcggggtgctgcggctgatgcgcgaggcgcacgacgcgctcggcctgcggccggcgtcggtgcgcctctcactgcgcgggccgggccggcgatacggcggtcccgagtccgggtgggcgctttccgagcggttgctgcggggcgcgctcgccgacaaccggatggcgtacgtcgtaggccccggcgaagcggccttctacggcccgaagatcgacgtgcaggtggccgacgcggccggccgggagtggaccatcgccaccgtccagctcgacttccaccagccggaacgcttcgacctgtcgtacgtgtcggcgtccggggcccgggcccgcccggtgatggtgcaccgcagcctggccgggtcgatggagcggctgttcggtcagctgatcgaggagcaccagggagcgttcccggtctggtacgcgccggtgcaggtggccgtgctgccggtcggcgcctcggggaccgcctcgttcgccgccgacgcggtcgccgcgggcctgcgcgcggtggaggtccgggagggctcgctcggcgcccggatccgggccgccgccaaggtgccgtacgtggcggtgatcggcgcccgggaagccgcggccggcctggtctcgctgcggctgcgggacggccggcagctggacccgatgcccgggtcggcggcgatcgcgctgatcagtgcggtcgccgccgcccgccgacccggtcagctcctgccgagtccgtaggtgagcgcgtcgaccagggcggtccagctggcctcgaccacgttctcgtgcacgccgacggtggtccactcgcggttgtggtcgccggtctcgaccagcacccgggtgatcgcgttggtgccgtggctgccctccaggatccgtaccttgtagtcgttgagctcgaacgacctcagcgccggatggtggtgggagagcgcggtgcgcagcgcctcgtccagcgcgttgaccgggccgttgccctcggccgtggcgatcacccgctcgcccttgacccgcagcttcaccgtcgcctcggagatcaccttgccgtcttcgcggtgctcgaccagcacccggtacgactccagggtgaacgggcgggtcacgtcctcgcccggcagctcgctgcgcaccagcagctcgaacgaggcgtcggcggcctcgaacgaccagccggccgcctccaggtccttgaccttctgggtgaccgaggtgagcgtgtccggatggccggccaggtcgatgccgagctcgcgactcttgagctcgatgctggcccggccggccatctcggtcaccaggatccgcatgtcgttgccgacaaccgccgggtcgacgtggttgtacagcagcggatccactttgatcgcgctcgcgtgcaggcccgccttgtgggcgaacgccgcggccccgacataggcctggtgggtgtcgggggcgatgttggcgatctcggcgagcgcggaggagacccgcgtcgccttctccaggcatccgtccggtaggaccttcagcccgagcttgagttgcaggttgctgaccacggcgaacaggtcggcgttgccggggcgctcgccgtagccgttcgcggtgcactggaagtgccgcaccccggcctcgaccgcggcgaccgtgttcgcgaccgcgcaggcggtgtcgttctggcagtggatgccgagccggtcggcgctcaccccggtccgctcgacgacctcggtgatcgccttggtgatcatcgaggggagcatgccgccgttggtgtcgcacatgatcacgcgttcggcgccggcgtcgatcgcggtccgcaccacgctcgcggtgtactccgggtcgaaacggaagccgtcgaagaagtgctcacagtcgaggaacgcccggcggccgttggcgaccaggtgccggaccgtgtcccggaccatcgccaggttctcctccgccgtggtgcgcagcgcccgctccacgtgccggatgtccgacttggccaccacgcagaccaccggggtgtcggcctccagcagcgcccgcacctgcgggtcggccgccacgtccacgccggccttgcgggtggcgccgaacgcgaccagcaccgcgtgccggaggttcagctcggtcctggcgcgggcgaagaactcggtgtccttgggcatcgcgcccggccagccgccctcgatgaaaccgacaccgaagtcgtccagcaggcgtgcgaccgcgagtttgtcggcgaccgtgtagctgattccctcgcgctgcccaccgtcgcgcagcgtcgtgtcgaacacctggtagtccatcggggaggtcctttcagtcggcacccacacaacaaaaagaccccccgcggatgcgggaggtctgcgcgtcggcggaaggaggccggcgcgctaggtgcgaataatcagcacgaggtgggtcacgagatgaagcatgccactatccgggctcaggggaggcgccgttccacttatcgagactagttttgtcaccgtggttgccgaatcttactcgcgaaatctcgggttctccgccacctacaacttccgcgacgtcggcggatacgccggcctcgacggccgcaccgtgcggtggcgacgccttttccgggccgactcgctgcaccgcatcggggacgccgacgcggccgccttcaccgccctgggcatccgcaccgtgatcgacctgcgccgtccgcacgaggtggagaagttcggccgggtgcacgaacgctacgggaccgactaccgcaacctggtgctcaagcacgtcgactgggaggaggtcgagcaccccgacgggacggtgcgcgagcgctggctggccgaccgttacctcaacttcgccgaggacggccgggaggcgatcctcgacgcgctgcggctgatcgccgacccggcggccgctccggtcgtggtgcactgcatggccggcaaggaccggaccggcacgatctgcgcgctcaccctgtccctgctgggcgtctccgactccgacatcgccaccgactacgggctgaccaccgaggcgatgcggccgctcaccgagtatctgctgcgcgccgacccggaagcggtcgagggcaacgagcacatgttcgactcgccgccggccgcgatgcggctgttcctggacgacctgcgggcgctgcacggcacggtcgaggactacgtccgggagatcgggctcaccagctccgagatcgacgcgatgcggcggcatctgctggagggctgaggacgccgggatcgcccgccggccggcgggcgatcccggcaccggatcaggcctggaagcgggtacgccggcggcgggcgatgaggaagctgaccgcgcccgcggccaccagcagaccgccggccccggcgatcgcggcgccctgcgggccggtgatcggcaggccgggcccgtccgagccaccggtgccaccggtaccgccggccgggttgagcaccagcagcgccttgtcgttcgacttgtcggtgtccttcgagaagatgtcgcactcacacgccgggttggcctcgaccgccccggacgcgcccggcacgaccttgtcgatcttcagaccgaatgtccagctgacggtctcgccgacccggaacaggtagccggtggagcagacgtactgcaccgccttcttgtcgctctggagccagtccgtggcgaccgcacagccgtccggcacggtggtgaccttggcaccggccgggatcgtgacgcgcagcacgctcgccgcgtcgccggcgtggttggtgtcccgcgtcgccgggccgttgttgcgcaccccgaccgtggcgttgaccacggtgccggccgcgcccgagaccttgtcgccgatggccgcgatgtcggtgctctgctgaccggtcacatcgacgtcgatcagcgaccagttgtcgtccgggttcgtgtcggtctggcgggcccgcgaggtggcggcggcgaccttcgtcagcttcagcatgccgccggtgccggccgtggtcttcagggccttagtctgcgcgtcgtagtcaccgaccggcagccatttgtactcggccgcgccgccgctgggcgccgcggtgtccgtgcgcacgcggaacgggaactccagggcgtaggtggcgcccggctcgaggtcctgatcgaaccggcagttcatccggatctcgtggtaggagcagttggagaactgcgcggtcggctcataggcgtagtccgcgtaaccgctcaggccgacgccgtggaccgtcttgtcgctcttgttcgtcaccgtcacggtgccggtgaaggtctcgccgaccttgaccttgtgcttgtccggcttgccggcgaccaggtcgacgccctcggcgacgacgacgttcgcggtcgacttgatcggggccacaccgtcagcggcgaaggtcgcggtcagcttcccggtcgagccgatcggcgtggtgcgcgaggccttcagcgcgccttccaggtaacccatcacaccgtacgggccgatgctgataccgaacggctgcttgcagaccaaggtggtcggcgtctgactcgcgcagtctccgaactcgtccgggttggccagggtgaccccggccggagtgccggtgagctggtacgtcatcaccgcgccggtgagctcgacctcgcggtcggcccgcagcaccggggacaccttgatcgcatacccggcgccgatggcgacatcgtccagggtgacgttgattttgggcgtggcggcgaaggccggtgtcgccgtggtgagggcgacggccgtggccgtggccagtccggcgagcaggcgccgggcggaggggcggtgcattggagagttcctcccgtggaacggtccgaagatcgcgagcccgcagcatagggaaacccctgacctgccgacacgcccgatgcaggggatcgcctggttccgtagccgaaccgcaacccgccgcacggcggtcaggcgtcgagatggtcgaccggggcgcgcccatccgcccgagccgccgccagatgggtctgcaatcgctgatacagacgcgcgagacgaggggagtaagggtcctcgcggtccgtagcgggcggcggatcacttcacgttcgatcgaaggcggacttgcggacattctggactccctgaagctgaaacccgggcgccgagatcatcgcacgtcgatgcgggtggctgccggaacgatgtcgcgtatcgggagggtccatggctgctcccgagccgcagcggtccgggagcggaccgcgggtctcgcggggcggctgggggtggaccaccgtaagggcacgccccggcccggatgctgcccagcgatccgggggtggcagcggtgtcgcgctgactcacgggatgggaccggtgcggttggggggaccgggaccccgtaccgccgaagtgtctttatcggtggttgaagggggcgacggcctcgcggttgcgggcggccgcctccgggccgaggagggcctcgcagacgcggatcaggcggctgcggagggcggccgcgcggcgggcgagttcgcgttggcgggcgacgtactcggctttgccctccggggtttcgatcttgaccggggggtggccgtaggaggccaggtcgtaggggctggcctgcatgtcgaggaggcggatctcgccggccagggcgaagcagtcgagggcgagggcgccgggcacggccgggccgagtttctgcgcccatttgtgcacgtccatcgcggcgtgcaggcagccgggctggtccaggtcgacctgggtggcgcgggtgggctgcaggcggttgaggccgaccgcctcgggggtgaagaagcggaacgcgtcgaagtgggtgcagcggatggtgtgctgctcgaccaccttgtcggtctcgggctggcccaggcgcagcgggagcgggtgccggtgctccgggtcgcggtagaccatggcccactcgtgcaggccgaagcagccggagaagaccgggcgggacgcggtggcggtgagcagaccgtggatgtagcgcaccgactcgccgcgggcgtgcaggaacgcgtcctggtcgagggcgacgacgccgtcgtcgtgggtctggtagaacttccagcccgcgtgctcggccaggccgtcgggggcggccaccaggccggcgccgacgcccggatgccagcggcgcagcatcgacgggcgggtgccgtagtagtcgtagaggaagtcctcgatggcgtgtttctcacccgtcgcccggcgggcacggtggcccgcggtcatctggtcggcgcgctcggcgtgcgcccgggcgaggggtatccaggtgaccgagggcagcgtggtggtgagtgccctcacctgcttgatccccatcgcaccaatgtatctagccgaagcgatcaacacgatcaccgttaggcgcgaatgaggtccgccacggcatgttctttcggggaccgggctgaggtatttccgtcttcttcggaatcgggcgatttgtgaaccggggccggccagcccagcccgggggctccgggcagcgcgaagcccagtcggggaccgagtcccagagtcaggacaacgacagaagccatactcaacaatgtagtacgtctactacaactttgatagcgtggtggacatgacggaggcggtagtgcggagcatcggcggcgagcagtcggtcgccgagccggtcatcgaggtccgcgacctgcggatgcgatacgggcccagggaagtgctggacggcatctccttcacggcgcgtcccggcgaggtgatcgcgctcctcgggccgaacggggcgggcaagaccaccaccatcgagatcctggagggcttccggcgccggtcggccggccacgtccgggtgctcggcgccgacccggagcgcggcgacgagcgctggcgggcccggctcggcgtggtcctgcagtcctggcgcgaccacggcaagtggcgggtccgtgagctgctgcagcacgtcggccagcactacaccccgttcagcaccggccggatcgtccggccctggccggtcgacgagctgctcgccgcggtcggcctgaccgccgccgcgcggaccagggtcagccgcctctccggcgggcagcgccgccgcctcgacgtggcgatcggcatcgtcggtcgccccgagctgctcttcctcgacgagccgacggtcggcttcgacccggccgcccgccgcgagttccacgacctgatccacgggctgaccgacatggccgacaccacggtgctgctcaccacccacgatctggacgaggcggagaaactcgccgaccggatcctgatcctcgccggcggccggatcatcgcgagcggctcggccgacgcgctgtcccgccaggtggccggcgagaccgagatccgctggacccgggacgggcagcggttcgtgcactcggcggcggacgccacgccgttcgtccgcgagttgttccggcagtacggggagcggatcggcgacctcgaggtgcgccggtccagtctggaggacacctacatgaagctggtgcacgaggcggagggcgcccgatgaccccgatccggatgggcctgcgccgcggcgcgatcgaggtgcggcacacgctgaccacgccgagcgacctgtggacctacctcttcccgtccctgctgctgctcggcacgatctatttcatgcgcggcgccacggtgcccggcaccagcttctcgctgggcgcccgcacgctgcccagcacgttcggcatgggcttcgcgacgaccgggctgatgaccaccgctcaactgctgatgatcgaccgggaggacggcaccctgctgcgggccaaggcggtgccgcgcggcatgaccagctatctgatcggcaaggtggtgctggtcggcgggatggcgatgatcagcttcctgctcgtgctgattcccggcctcttcctggtcgacggcctggacgtgaccggcggcgactggctgaccatgctctggctgatcccgctcggcctggtcgccaccctgccgctgggcgcggcgttcggctcactcttcgaggacccgcgcaacatggcactgatcgtgctgccgatcttcgggagcatcgcgatctccggcatcttctatccgatcagcggctttcccggctggctgcagggtgtcgcccagagtctcccgctgtactggctagggttgggcatgcgctcggtcttcctgcccgactccctggcctcggccgagatcgcgcactcctggcggcacctggaaacgttcggcgtgctgaccggctggtcgatcctcggcctcgtgctggccccgatcctgctgcggcggatggccgcccgcgagtccgggtcggcggtcgaggcgcgacgcgaacgcgccctgcggcgggtggggcgctgacccggcgatggcgacggagatcacgtacaaccggatcgccatgctccgcgcggagcgcggcatctcccgccggcagctggcggacgccctcggcgtgcactaccagaccgtcggctacctggagcgcggcgagttcagccccagcctccacctggccctgcggatctgtcagtacttcgaggtgccggtcgaggtggtcttcgcgctggagcctttcccgcggctcggggcggcttcgcaatcggcgtagattttaggggtccgtccttctgcagatggggatacccgtgcgcttcgcccgttttgttcatgccgctggagtgtcgttcggcgtcgtcgagggtgacggcgcctccggcctcacggtggccgagatcagcagcctgccgttcgagaaggtcgtccgcaccggccagcgctgggccctgcccgacgtccggctgctcgcgccgatcttctccagcaaggtgatcggcatcggtcgcaactacgccgaccacgccgccgagatgggcaacgaggtgcccaaggagccgctgatcttcatcaagccgtccacctcggtgatcggccccggcgacgccatccgcatcccctcggtcaccacccaggtcgaggaggaggccgagctcgccgtcgtgatcggcgccaccggtgcccgccgcctcgaccgggccgccgccgagaaagcgatcttcgggtacacctgcgccaacgacgtcaccgcccgcgacctgcagcgcaaagatccgcagtggacccgggccaagggcttcgactcgttctgcccgctcggcccgtggatcgagaccgagctcgacgtcagcgacctggaggtccgctgcgaggtcggccgcgacccggcgaacctggaggtccgccagatcggccgcaccaaggacatggtcttcgacatccccagcctggtgtcgtacgtctcgcacgtgatgaccctgctgcccggcgacgtgatcctgaccgggacgccggccggggtcagcaggatcgagccgggggacacggtgtcggtgagcgtgcagggcatcggggagctgcggaactcggtcgtcgccctcgactgaccaccgccatcggggaggcggatccggtcacggctgcggcctgctcccgatccgcttccgattgcggcgtacgccgtgggccgccatacccgcccggaccggccgtccccggtttgagggcgcgccgcccgccctgccgtgcggccctgggtccgatggcgctcgccgctagctagctagcgcgccgcccgccgtgccgtcctcggcccgatggcgcgccccgcccgccgggctgtccggtgccgtcgcatcgaccggcgtttgacctgctcggacgcctgggggtgggttactgtcggtgggcgagccgtcacgcggaccagtttcggtaacccgatttggcgggcggggagggctcgggtaaagttctcaacggctcggcaagccgggccaaatggggtatggggtaattggcagcccgactgattctggttcagttagtctaggttcgagtcctggtaccccagcgttaccaacctccgggttggtgccgctggaagcgcttcggcgcaaacagcagttctggtcccgtcgtctagcggcctaggacgccgccctctcaaggcggtagcgagggttcgaatcccttcgggactacatcggaaacaacccgcatccatcggatgcgggttgttcgcttttcggatcgtttccggccaagccgctcgtccggaccggtgaaccggctgcctgaccatcaaccgccgccgggcactccgccccgccgggcactctgccccgccgggcactctgccccgccgggcagccttctacgccgcgccccggccttgcgccaggccgaggccccgagatcgtggccctgcgcgggttgtggcgctgggccggttgtggcgctgggccggttgtggcgctgggccggttgtggcgctgggccggttgtggcgctgggccggttgtggcgctgggccggttgtggcgctgggccggttgtggcgctgggccggttgagtctctgcggcgtttttggccccgcgtcagccccgctgtgggcagcggttgtgggggccgtcacggtggggccggtggggcaggaggtgattcggggattcggcaaaggtgctgatagagttcagcgcgccgcccgggcagggtggtggaagaaagtcttggtcccgtcgtctagcggcctaggacgccgccctctcaaggcggtagcgagggttcgaatcccttcgggactaccaagcacaatggcccgcaccgtgatcggtgcgggccatttctgtgttccgtgaagctttgtgtcgccgtcggctcaacggaagtctttaagccgagtccgatatctctgcctgaaatgtggcattagcagacggtgtgaggggtgccgggtcgggtccggtgagggcgcccggtctggtggtgcccggttgggtcggatgaggccgcccgctctgatggtgcccggttgggtcggatgaggccgcccgctctgatggtgcccggttgggtcgggtgagggcgctcggtctggtggtgccaggttgggtggggtgagggcgctcggtctggtggtgcccggttgggtggggtgagagcgaccggttcgatggcggtggctcaatcgggcgaggggcgatcgggtccggtggtggccgttcggtccggcgaggggcgatcggcccgacgacggcggctcggtcgcggaaatgaatgcgcccgatggcgcgggagcgacatcgggcgcgaggtggaggtcggggcgggtcgggaggtcgggccggggagggctacagcccggagagacgctggccggctcggacgaccgccatggcgtggcgttcgccggggcggcggcccaggcgctcgatcgggccgcttatcgagatggaggcgatgacccgcccggtccggtcgcggatcggggcggagacgctggccacacccggttcgcgttcggcgacgctctgcgcccagccgcggcggcggacctcggccagggtgcgaccggtgaacttgcaccggggcagcaggggcatgacggcttccggcggctcccaggcgagcaggatctgggcggcggagccggcgaccatcggcagcaccgagccgaccgggacggtgtcgcgcaggccgctggcgcgttcggcggcggcgacacagatgcgctcgtcggcgcggcgcaagtacagctgcgcgctctcccccgtggcgtcccgcaatgcggaaagcaggggctcggcggcggtcagcagaacgtcgggtgcggcgttcgccaactcacccaatcgaggtccggggcgccatcttccttgagtgtcccggaccagcatccgatggatctccagagcctgtgccaggcgatgtgcggttgcccgcggaagtttggtgcgctctaccaattcggccaggctggcgccgtcgacacaggcggcgaggatgacaaccgccttgtcgagaacgcctacaccgctcatactgtgtcccacaagccgaaacatacattccagaatttaggatgtccagatggtgggagtcactcccgacagcgggaaacccaggaccctggccgagaaggtctgggatgaccacgtggtgcgctcggccgagggagagcccgacctgctcttcatcgacctgcacctgctgcacgaggtcaccagcccgcaggcgttcgacggtctccggttggccggccgcaaggtccgccgcaccgacctcacgctggcgaccgaggatcacaacaccccgaccgggtatgcggatccctccttcaacacccgccgcggtgagctgctgaccatcgccgacacggtttcccgcacccagatcgagaccctgcggaagaactgcgccgagttcggcgtcgagatccgcccgctcggtgacgtgaaccagggcatcgtgcacgtgatcggcccgcagctgggcctgacccagccgggcaccacgatcgtctgcggtgactcgcacaccgcgacccacggcgcgttcggcgcgctggccttcggcatcggcaccagtgaggtcgagcacgtgctcgccacccagacgctgccgcagtcgaagccgaagacgatggccgtcacggtcgtcggggagctcggcccgggcgtcagcgcgaaggatctgatcctcgccctgatcacgcagaccggcaccggtggcggcaacggccacatcgtggagtaccgcggcgaggcgatccgcaagctctccatggagggccggatgacgatctgcaacatgtcgatcgagtggggcgccaaggccggcatgatcgcgccggacgagaccaccttcgcgtatctgaaggatcgccggcacgccccgcagggcgccgactgggacgccgccgtggcgtactggaagaccctggtcaccgacgaggacgcggagtacgacaccgagatcatcctggacgccaccaggatcagcccgttcatcacctggggcaccaacccgggccagggtgccgcgttgaacgacgtggtgccgaacccggcggacttcccggacgaggtggagcggggcgccgccgagcgcgccctggcgtacatggacctcaccccgggcaccccgttccgcgaggtcccggtcgacgtggtcttcgtcggctcgtgcaccaacggccggctggaggacctgcgggccgcggccgacgtgatccgcggccgcaaggtcgccgccggcgtccggatgatgatcgtgcccggttcctacctggtgcgcgagcaggcggaggccgagggcctggacaagatcttcaccgatgcgggcgccgagtggcggttcgccggctgctcgatgtgcctgggcatgaacccggacacgctgagccccgggcagcgcgcggcgtccacctccaaccgcaacttcgagggccggcagggcaagggtggccgcacccacctggtctcgccgcaggtcgccgccgccaccgcggtggtcggcaagctggccgccccggccgacctctgagcaggagtaaacagacatggacaagttcgtcacgcacagcggcaaggtgctgccgctgcgccgctctgatgtggacaccgaccagatcatcccggcggtgtacctgaagcgggtcacccgtaccggcttcgaggacggcctcttcagcgcctggcgcgaggacccgtccttcgtgctgcacaacccggcgcacgccggcgccaccatcctggtggccgggccgaacttcggcaccggctcgtcccgtcagcatgccgtctgggcgctgcgcgactggggtttcaaggtggtgatcgcggcccggttcggcgacatcttccggggcaacgcgctcaaggagggtctgctgccggtccagctcgaccagaagatcgtggagagcctctgggatctggccgagagtgagccggaaaagcagatcaccgtcgacctggccgagcgggtggtgcgcgtggatgacgcggcgtactcgttcccgatcgacgatttcagccgttggcgtctgctggaggggctcgacgacatcggactgacgttgcgccacgaggacgcgattagcgcgtacgagaagagccgtccgtctttcaagccggtcgtcgttctttaacccgagactgaattcgcccctgtcggtgtcgccgatgggggcgaatttcgttgggacacaacggatttttgccacgaatgtttgtgtctccaggtcagagggcataccgtgcgcgcagaatggcctgcgacgggccagttctcacgtccgggaggaaaccgtgaacaaggccgagctcattgaggcgctcgccgtcaagctgggggacaggaagacggcgaccattgcgctggacgcgttcatcagtgaggtgcagaacgccgtcgccaagggtgacaaggtctccctcaccggcttcggatcctgggagaagcggacgcgtaatgcgcgcaccgcacggaatccgcgaaccggtgagccggtgaaggtgaagaagacgtcggtcgccgcattccggcccggcaacaccttccgggacctcgtcgccagcggcaaaccggccaaggtggcgtccgccaagaagaccacgtcggcgaaggcggccgcccccgcgaagacgaccgcgaccaagacggccacggcgaaggccaccgccaccaaggccaccgccaccaaggccaccgccaccaagtcggcggcgaccaaggcgacggccaccaagacgaccggtacgacggcggccaaggcgaccggtacggcggccaaggcgaccggcgcgacggccaaggcgaccggttcgacggccaccaaggccggcaagacgacggtcaccaaggccacgccggccaagtcggcggcgaagaagacggcggcgccggccaagtcggcggcgaagaagacggtcgcgccggccaagccgaccgcgacgaaggcggcggccaagaagaccaccgcacccgccaagaccaccacgaccaaggcagcggccaagaagaccacggccgcggcgaagaagaccaccgcccgcaagaccgcggcgccggccccggctccggcccgggccaagggtgcctcgacggcccgggccgcgtcgagccgcaaggcgcgctgaccgcaccgcacgacgaacaggcagggcgtccaccgtacgggtggacgcctttcgttcgtcccggccccgtgccgccccggctctacggtccgggcatggaacgcggaccgagagggctgctcacccgggcatcgctggccgccggcctgttcgcggtgaccgtcgtcccgggatggacgctcggcgatctggccgagcgtgccaccggctggccggcgctggactggttgatcacctgcggctggtccggtgtggtggtggccgggtacgccccgtggacgtcgtaccgggcgcgggacggactggccggcgcggtcccgctctacggctggtatctggccggggtgctgagctggcgggtggcgctgctgccctttcgcgactgggaaccgcgccgcgacgagttgtggcgggcccgctggctgaccggtgacctgatcggtttctggcgggccgatcaggccggcgcgcggccggtcaccagcgcccgatcgcgagcagtcgctcgccggaccaggtgagcagccagccgtcgcccttgcgggtcttgaagggctccggatccggtgcgtcgcgcaggccggcgagcaactccgggatcaccttgccctggctgcagatcaccacccggtcaccgcgccgcagctcgtccagccggccgcgggcctccttgagccgcgccggcagcccggcggtcaggtcgtccggctcggcgaacgcgatgtccgagacgatcggcagtccggtcgccgcggccagcggctgcagcgtctgggtgcaccgcagcggcgtcgcggcgaccagccgccgcggctggaaggtggccagccgggcggccacccgctgggcctgccggccgcccttgacgctgaccggccgcagcgagtccggaccggaccagtctttccggtcgccggcgtgcgcgtgccggacgagcgccaccaccgaggtgatcggcggcaacccggcgacccggtcgagcagcggccgctcgtccggataggtcagtcgcgcggcggcgtccggcagcggcagccaggccagcctgtcgacctcggcggtgtcctggatcgggccggtcgtcccggcccgcatcagccagtaccgcaccgttttggggcgcccaccgggcagctcgtacgcgatctcgggcagggacatctccgggatgccggcgaccccggtctcctcggccacctcacggaccgcggcggccagggccggctcgccccgccgcagggtgcccttgggcaggctccagtcgtcgtagcgcggccggtggaccaggcagatctcgggcacaccggcgcggcccgggcggtacaggaccccgcccgcggcgcggaccgctgcggccatcaggccttcttgccgatgatgcggcgcagcaggagctcctgcaggtgcgcctgcgccttggcggtgtcgccgctgtgccggtgccagtcgccgtcgccgtcgaggtcccagccctcggtgccgtccgccatggacagctccaggacgttgcgcagctcctcgcgggccgacggcatggtcaccttgaccagcgcctcgacccgacggtccaggttgcggtgcatcaggtcggccgagcccatccagtattcggcgtcgtcgcccgcgccgaaccggaaaatccgggagtgttccaggaaccggccgacgatcgagcggacccggatgttctccgagaggccgggcacaccggggcggatcgtgcacatcccgcggatgatcaggtcgattttcacgccgtcctgcgaggcgcggtagagcgcgtccgtggtctcctcgtcgaccagcgagttcaccttgaactgcacgagcgcctcgccgccggatcgggcgatcttcgcctgctcggccagccggtccagcaggccccggcggacgccgtgcggggcgaccagcaggcggcggtacgtggtctgccggctgtacccggtgagcacgttgaacaggtcggtgacgtcggcgcccacctcgggatcggcggtcagcatgccgaaatcctcgtacaaccgcgccgtcttggggtggtagttgccggtgccgatgtggcagtagcggcgcagctggttgccctcctgccggaccacgagcgcggtcttgcagtgcgtcttgagcccgaccaggccgtacaccacatggcagccggcccgttccagggtgcgcgcccaggcgatgttggcgacctcgtcgaaccgggctttcacctcgaccagcaccaccacctgcttgccggcggcggccgcgtcgaccagtgcgtcgacgatcggcgagtcacccgacgtccggtacagcgtctgcttgatcgccagtacgttcgggtcggccgccgcctgctcgatgaagcgctgcacgctggtggagaaggaatggtagggatggtggaccaggatgtccgactcccgcagccggttgaacacgctgcgcggcacctcgccgtcggccagctgcggatgggtcgccgggacgaaagggcggtccttgagatcgtcccgatcgcactcgccgaacacctgccagagtgccgacaggtcgagcaggccgggcacccgcagcacgtcgtggctgtccatgtcgagctcgcggaccagcaggtcgagcacgtggtcgctgatcgaggcggccacctccaggcggaccggcggaccgaaccggcgctgcgccagctcccgttccagggcctgcagcaggtcctcgtcgcggtcctcgtcgacctccagctcggcgttgcgggtcacccggaaggcgtgcacctcgaggatctgcatgcccgggaagagctggtcgagatggttcgcgatcagctcctcgatgggcaggaagcggaccgcgcggctgtcgttctgcacggtcacgaaccgcggcacgttgttcggcaccttgatccgggcgaacagctcggggttgtccccgtccggatagcgcagggcgacggccagattcaacgacctgctggagatgtacggaaaggggtgcgccgggtccaccgcgagcggcgtgagcaccgggaacacctgctcgcggaagaaggtgcgcagccggccctgctcgggggcgtccagctcgcgccagctgaccagctcgatgctctccgcggcgagtttcggccggacctcgtcggcgaagcaggcggcgtgccgggtgaccaggtcggcggtccgggcggtgatcgtctcgatctgctgccgcagggtggagcggtcaccggtgcggaccggcagtccggcgttcagccgccgtttcaggcctgcgacccggaccatgtagaactcgtccaggttgctcgcgaagatcgccaggaatttggcacgttccaacagcggcgtgcccgggtcctcggccagggccagcacccgggcattgaagtcgagccaggacatctcccggttgaggaaccggtcctcgggcaggtggtactcgccgtcgaccggctccaccggcagctccgcctccgccgcctcgccgccggccgccgccggctccgcgccgattcccgcctcctgcaccgggtcggccggtgcgacgtcaacggcgggaccggcgggcacgactctggtcaggaagcggccgttcgggccacgccggcgggattcggagctccggggcggggtctgcatgcgtccatcattgccgctccggccggaacgtgaaacgaactactggatgatcgactcaggcgattcccggaattttcacctggcgtaccaccccgcccggttcggcctcgatcgagacccgttgaccgaggcgcagcagccgcagcccggaacgggcgaacgcgtccgccccgaaggccagttcagagccgtcgtcgaggagcagcgtgccggtgcgggtggccgggtcgaaggtcgcgatcgtgccctgcattccgctgacgctacccggcgcagccggccggggtgcacacctggttgagtccgagatcacggagcagctcacgggtccgccggccggcgcccagggccagcacggcggccaggtcggcgggcgtgtcgacgtcctgtcgcaggcccggccagtcgccggccagaacggtcgcgccggaggtccggtgcgcggccgccgagcccgggccgaacagcggatcgagccgctgcccgggcggcacggcgagcagcacggtcccggtccccgcggcgtccgggacgaaactgcgatggggtacggccgcaagcgccgcgtcgagctgggccgggcgcaacgccggcaggtcgccggtgagcaccgcgcgatacgcggcgagaccggccacctcgtcggcgccggagcgcatcgcggcgttcagcccggcgcccggatcgggcgccacctcggcccccagccgtcgtacggcgtgcccggcgaccggatcgtccgtgacgacgatcaacccggccaccgtggtggcgctcaccacagcggtcacggtgtcgcagagcatcgccagcaccagctccggatgccgttcctcgggcaccgcgccgcgcaaccggctcttggccgcgtccagccgcttgaccggaatcaccgtcatccacttccgcaccgacaccccgcaagtctgcatgacgtgtaccggcaacacccctacctggtacgtcgggccggcagggggcatgatttcgtcgcagacgcaggcgacatggtcgccgatcgagggacgggagaggccgtggcgcagcacaggctcggattctggcagcgtttcgcggtgatgctggtggtccccgtcatgaccgtctggacgaagcggacctggctgaggatggaccgcatcccgcaggcgggcggggtgatcctggtccccaaccacgtctcgcacttcgacccgctggtcgtggcgcactacatctacaaggccgggcgctggccccggttcctcggcaaggccagcctgtggcgggtcccgatcgtgggaccactgttggtcaagaccaagcaggtcccggtcgaacgaggcagtgtggaggcggtgaaatccctggagtcgctggtcgacgcgctcaccgacggcggcgccgtggtcatctatccggagggcaccacgacccgcgagcccgacctgtggccgatgcgcggcaagaccggcgcggcccggctggcgctgctcaccggcgccccggtggtgccgatcgcgaactggggagcgcagcgcgtcttcgacccgcgcaccaacaagctcaagctgacccgggccggggtcaccgtcaccaccggcgacccgatcgacctgagccggtgggccggcgccgagccgacccgcgcggtcctcgacgagatgaccgaccacatcatgctcggcatccgtgatctgctgggcacgatccgcgacggcgaggcgccggcgctctacgaccggcccgctcggcgggtcacgaaatcggaggacgcgtgatgagggccgccgtcatcggatccggagcctggggcaccgcgttcgccaaggtgctgggcgaggccggctccgaggtgaccatgtgggcccggcgcgggtcggtggccgccgagatccgggacgagcacggcaacgagggctcgctgcccggcgtccggttgtcgaagcggatcaccgcgaccaccgatctggccgaggcggtcgacggcgccgagctgatcgcgatcgcggtgccgtcccagacgctgcgcggcaacctcgccgactgggccggctacttccccggcgacgccaccgtcgtgtccctgatgaagggcatcgagctgggcacgctcaagcggatgagcgaggtgatcgtggagaccgcgggcgtgccggccgagcgcgtggtggtggtctccgggccgaacgtggcccccgagatcgccgccgggcagcccaccgcgaccgtggtggccggcgccgacgaggaccgcgccaagcaggtgcagcacgccctggccacgccgtatttccggccgtacaccagcgacgacgtgatcggctgcgagctcggcggggcgaccaagaacgtgatcgccctggcctacgggatggcgatctcgatcggcctcggtgacaacacccgggcctcgttgatcacccgtggtctcgccgagaccgcgcggctcggggtggccctcggggccgacccgctcaccttcgccggcctggccgggctcggcgacctggtcgcctcctgctcgtccccgctggcccgcaatcggatgttcggcgagcacctgggccggggcgagagcctggagcaggcgcagatcgccacccggcagaccgccgagggggtgaagagctgcctgtccatccgcgacctggcccgctcgcacggggtcgagatgcccatcgtcgagcaggtcgagcgggtctgtcacgagggcgccgacccgcgggtcgcggtgaaactgctgatgacacgagagatgaaacccgagtgagctactccgacggcacccgctccgtccacgccggcctgcccgcgcccgaggtggggcagccgttcctgcccgggccggtcttcgcggcgccctaccacctggacccggtcaccgggccgggtcgccacgggtatgcgcgcaccgagcagccgaccagacaggccctggaggccgcgatcggcgagttggagggcggtccggcactggccttcgccagcggccaggcggccatcacggcggcgctgctggcggtgctgaaagccggcgaccgggtggcgcttcccggcgacggctatttcccggtccgcgcgttcgcccacggcgccctgaccgacctgggcgtgacgagtgtgctggtgcccaccgccgggccgtacccggacttcaccggtctgcggctggtgatgctggagacgccggccaacccgggcctggacgtcgccgacatccgggcggtggccgccgccgcgcacgcggccggcgcgctgctcgcggtcgacaacaccgccgccaccccgctcgggcagaacccgctggccctcggcgccgacctggtcgtggcgtccggcaccaaggccctgaccggccactccgacctgctgctcggctacgtcgcggcgaccgaccgcgagctgctggccaaggtcgagacgtggcggaaactgaccggtggcgtgcccggcgcgttcgactgctggctggcccaccggtcgatcgccacgatggacctgcggctggcccggcagagcgagaacgccgccgcggtcgccgatctgctggtgagccgctccgaggtgaccggggtgcgctggcccggcctcccgagcgatccgtcgtacgcggtggccagtgtccagatgcgccgggtgcccggcatcgtctcgttcgacctgggcagcgccgagcgggtggcccggttcctgtcggcggcgaaactggtcttcgcggccacctcgttcggcggcgtgcacaccacggccgaccggcgcgcccagttcggcgacgacaccccgccgggcttcgtccgcttctcctgcggcatcgaggacaccgccgacctgatcgccgacgtcacccaggcgctggacgccgcacggtgaccgcctggcgcagtttcagcggcgacgaggtggccgcgctgacccggggggagagcttcttcgcggcgccgggcgagcgggactgcccggcctgcggcggcccgcacctgcgggcgtacttcaccgcgccggcgaacgcccggcgtcccaccctggtcagctacgtctggtgcaccggctgcggcaggttcgtcggcacccgcgcgcgacacccggcgggcctggtcttctccgacccgctcgcggcgctgcccgccggggaacgccgcgagctggaacgcagcctgacgggcttcctggcccacctggacacgctgtgggactcgggcgccctgccgcagaccttcgcggcctgacgacgggtgcggcgcgacgtacgccgcgatcgtcctgatcgctgccggggttcgccgtcaacgggcgacgaagtcgtgcagccactcctgggcgaccggttggcccggggcgacgccgatccggcgcagggcctcacccggacggatgccgagcagcgccagggtcatggtggcgagcagggtcgtgcggccgagttcggcgctcgactgggtgaccacgaaacgaccggaacggacctcccgggcgagccgggtggccagcgcgaccatctcggtggcctcgcggcgcggagccgtctcgtccggatcggggtagtcgatcagctcgatcccgacgccggccgtcgcgggcggacggtgccgcgcggtacagaccaggatgtgcacgccggcccgggccagagcggcgagttccggcggtgaccacggggtgtcaccggggtgtgccatggtggccaattgccccggccccggcccggcgatcacgtggagtgctggtcccatgaactgttcgtctccccctgcctcggcagcggccgccgcgatcccacatctggcttacgcagagtagggtcacccccggcatgcccgctagcgagaggcgcagagaagagtgacaaccccccggaagacccgtgtcgcgatcgtgttcggcggacgcagcactgagcacgccatttcctgcgtgagcgcgggtgccatcctgggtgcgctcgaccccgatcagtacgagaccgtcccggtcggaatcacccgggagggtcgctgggtgctcgccgccggagatccggcgcagctcgccatcgccggtgagcggctgcccgagatcaccgccggctcgggcagcgcggtggtgcttcccgccgacccgaccgccgccgagctgatcgtgcgcgacccggccgacggcgtcgccgagctcgccgagctcgccggggtcgatgtggtcttcccggtgctgcacggggcgtacggggaggacggcaccatccagggcatgctggagatggccgggattccgtacgtgggggccaacgtcttcgcctcggccgccgccatggacaaggagttcaccaagaagctggccgccgccgagggcatcccggtcgggccgtacgcggtgctccgggccggcatgtcgctcaccgaggcggacaaggagcggctcgggctgccggtgttcgtgaagccgtcgcgggccgggtcgtcgaccggcatcaccaaggtcaccgactgggccgacctggacgcggcgatcaccaaggcccgtgagatcgaccccaaggtgctcgtcgaggcggcgatcgtcggcagcgagatcgagtgcggcgtgctggagggtgagttcggcgggccgccgcaggcgtcgctgctcgccgagatccacatggacggcgccgactggtacgacttcgcgacgaaatacctggtgggaagccgctacacgatcccggccgcgctgccgcacgatctgacccggcaggtccaggagtacgcgctgcgcaccttcaccgcgctggactgcgccggcctggcccgggtcgacttcttcgtcaccgcggccggcgaggtctacctcaacgagatcaacacgatgccggggatgacgccgacctcgatgttcccgcagatgtgggcggccaccggcctggagtacccgaaggtggtcgaccggctgatccgcaccgccctgcgacgcggcaccggcctgcactaacggcccgggtcgcacccgttcggcacgccggcggtgatcgacttgtcggtcttcagcacgatgtcggagaactcgttggcccactgggcccgcttgtcgtacgtcgccggcacggtcacctgcaccgggacctctcggtccatcgtggtgaagacggtcttgccggcgccctcggtgtaataccagcagacctggtccatcagcagaaggtcggcgaccagcggcacgcacgtgccggaggtgtcgtcggccttctcgcacatccagggccgggtgaccccgcaggccacggtgatcgcgggctcgccgtacgccgcgttctgctccgggccggcgctgaccttgcgggccggcaggttccggatccgggccggcagctgcgaggtgaccgccaggcacacctgggcggcccgggcgtccagctcgggcgcgtcgacccggaccggggtggtgggcaccacggccgggccgctcgccgacggcgccgggtcggccgccggcgtcgtcgacctactgatctgcaggtaggcgacgagccccacgatcaggaccaccggcaccgcgatcgcggtcgcccagatggcggcgacccgggtggtgttgtccggcgtgctgtcgtccggtttcgcgggggtgtcgacgtcgaccatggttcagaggtttaccacggagcacgtgagggtccgggtgatacccggcacgtactggaccttgctcacaatcagggtgcccaattcgtccacgttgtgcgcctcggtcagtacgaccacgtcgtacgggccggtgaccgcgtcgactcggaccacccccgggattttctcgatcgccgcggccacgtcacgggccttaccgacctcggtttgaatgaggatgtatgcctggaccacgatcgactcctatccgccaccgtcggtgatccccgaaaagtgaaactaccgtacgaagcggcccggcagcgggacgccaccatcgaaggacgtgcccgtgagcatcgcagagtccggtgaattcggactaattggtcgaattgtgtcgcgactcgacgccggttcggccaccctgctcggtcccggcgacgacgcggcggtggtgcgcgcggccgacagccgggtggtggcctccaccgacgtgctcgtcgagggacggcacttccgccgcgactggtgcggcccgcaggacgtcgggcatcgcgccgccgcggccaacctggccgacatcgccgcgatgggcgccaccccgaccgcgctgctggtcgcgctctgcgtgccggccggcctggacgccggctgggccgagggcctggccgacgggctcaccgccgaggcggcgctctgcggggcggccgtggtcggcggcgacatgtcggccagccccacactcaccgtcgcggtcaccgcgctgggcgacctcggcgggctcgacccggtccgccgctccggcgcccagcccggcgacatcctcgccctgtccgggcggatcggctacgcggcggccggttacaccgtgctgtcccgcggcttccggaccccgaagatgctggtcgaggcgtaccgccggccggccgtgcggtacgccgccggccccgaggcggcccggctcggcgccacctcgatgatcgacgtctcggacggcctgctgcaggacgccgggcacctggccgacgccagtgtggtggcgatcgacatccggtcggacgccttcgaggtgcccgatcagatgcgggacgcggccaaggcgctgggggtggacccctaccagtggatcctggccggtggcgacgatcatcccctggccgcgaccttcccggcggggacccggctgcccgaggggtggcgggagatcggctcggtgcacgacggatccggcgtcaccgtcgaccgcaagccgtggtccgggccgctgggctgggatcactttcgttagtcggcgccgtcgctgattacgctggcggcgtggtgcagatcaagatcaggacggctcggttcgacgagccggaggtggtggaactggtcgcggagaacatgcgcgacctcgccgagcggtatggcggcacgggcgacgacacgccgatccgggcggccgacttccttgcgccggacggtgcgttcctcgtggccgtccgggccgacgacggtgccctggtgggcagcgccgggtggcggcggcacggaacggacgccgagctcaagcggatgttcacccgggccgcggcgcgcgggctcggggtggcccggcggatgctggcggcgatcgaggagtcggcccgggaggccggctgcgaacgggtgatcctggagaccggggaccggcagccggaggcgatcgcgctgtacgagtcggccggatacgtgcggatcgaggacttcggctactacaaggggcacgagggcgtgctctcgtacggcaagaagatctagaaaggaaaaacccgccgagtcggtgactcggcgggtttccacacgatggagctcaggcgcgggcaaccttgccggccttgatgcacgaggtgcacacgttgagcttcttggtcgtcccgccaccggccggagtgcgcaccgactggatgttcgggttccagcggcggttggtccgccggtgcgagaaggacacgttgtggccgaagcccggtcccttgccacagacgtcgcacacgctagccacgggatactcctgggtttgaaacgaagactgagaagcgcccaggaatactcgcccaggcaacccggcgagcttacccgatgctgccgggtgacagccaatcgcccccggtcagggtgcgtacccagcgattgtcagaggtggttagtacgattttcgcgtgctggagaccctcgatgccgccgccgtgcaccgctggtgcgacggtgggctggaggcgctccgggcccaccagcgcgagatcgacgagctgaacgtctacccggtgcccgacggggacaccggcaccaacctggtgctcaccctcaccgccgcacgggaggcggtcgagtccgccctgcacgaggagccgcgtacgccgatcggccggctgatgggccggatggcgcgcggcgcgctgctcggggcccggggcaactccggggtgatcgtgtcgcagatcctgcgcggcatggccgacgcgttcgccagcgcggtcgccgtccgcggcgccgagctggcgcacgcgctgcggcaggccagcgaggcggcttacgcggcggtggcccgcccggtggagggcaccgtgctctcggtcgtcgcggccgccgccgagggcgccgggcggatcgggtcggacagtctgatcaccgtcgcccgggcggccgcgcgggcggccgccgaggcgctcgatcggacgccgcagcagcttcccgagctggcccgggcgggcgtggtggacgccggtgggcgcggcctgtgcgtgctgctggacgccctggtggacacggtggcggagacggcgttctcaccctcgccgccgccggttccgctgccggccgccccggtcgtcgaggaccactgcgagggccacggctacgaggtccagtatctgctggaggcgccccccgaggcggtggagcgactgcgcggtgccctggccgggctgggcgactcgctggtcgtggtcggcgatccgcccacgtggaacgtgcacgtccacgtccccgccgaggcgatcggcccggcgctggaggcgggtgtcgaggcgggccggccgtaccggatcagtgtcaccccgctggccgggaagcggcccggcgccgagtcgcgcggcgcggtggtcgtcgccgccggcgacggcctgaccgcgctcttcgaggccgagggcgcggtggtggtcggccgcaacccgtccaccgccgagatgctggccgcggtgcgcgcctgtgccgccgccgccgtggtgctgctgcccaacgacgcgaacacgctcgccgtggccaccgccgcggcccgcgaggcggaggccaccgggctgcgggtcagcgtggtgccgacccgctcgccggtgcaggcgctggccgccctcgcggtgcgtgaccactcccgcccgttcgccgacgacgtgatcgcgatggccgaggcggccggcgcctgccgctacggcgaggtctgcaccgcccagcgcgacgccctgacggtggccggcccgtgccgcgccggcgacctgctcggcctggtcgacggcgaggtgcacgtgatcggcgccgatctgaccgacgtcagtcaccgcctgctcgaccggatgctgggcggcggcggcgagctggtcaccctggtcctcggcgcggacgcgccggccgagctggcggacgacctgcggggccacgtgcaccgcatctggccgttcatcgagctgcagtgctacgccggcggccagccccgctaccacctgctggcaggagtggaatgaccacgaccgacaccccgctgaccaaggtgctgggggccaagacggcgaaggcgctggccgagcacctggagctgcacacggccggcgatctgatctaccacttcccccggcggtacgacgagcgcggcgagcacaccgacctgcggcagctggaggtcggcgagcaggtcaccgtgctggcccaggtgcaggggatcggcgtcaaaccgatgcgccagcgcaagggcaacatgctggaggtgaccatcggtgacggctccggggccaccctgacctgtacattcttcaaccaggcgtggcgtgagcgggagctgacccggggccgctgggggctgttcgccggcaaggtcaccgagttccgcggcaagcggcagctcaacggcccggcctatcagctgctcaaggtggacgccacgcaggacgaggcggccgaggagatcgaggagttcgccggcgcgctgatcccggtctatccggccgcccaggcggtgcccacctgggtgctcgccaagtgcgtgcgcaccctgctggacaccttcgagccgccgcccgacccgatgcccgccgaggtccgggcggcgcgcaatctggtcggcatcggcaccgccctgcgggagatccaccggcccagttcggacgccgcgctctactcggcgaaacaccgcctgaagtgggacgaggcgttcgcggttcagctcaccctggcccagcggcgggctcgcgcggcggcggctccgggcacggcccggccgcgccgccccggtggtctgctggacaggttcgacgccgatctgccgtacgagttgaccgacggccagcgatcggtgggggaggagatcgccgccgatctggcccgggcgcacccgatgcaccggctgctgcagggcgaggtgggttcgggcaagacgctggtctcggtgcgggcgatgctgcaggtggtcgacgccggtgggcaggccgccctgctggcacccaccgaggtgctcgccacccagcacttccgcgggatcggtgcgcagctgggcgcgctgggccgggccggtgagctcgacggtgacccggagggtacgcagctcaccctggtgaccggttcgctgggggcggcggcccggcgggcggcgctggccaaggtggcggacgggagcgccgggatcgtggtcggcacccacgccctgctctacgagggggtcgacttccgggatctcgggctgatcgtggtcgacgagcagcaccggttcggcgtcgagcagcgggacgcgctgcgcgccaaggccgcccggccgccgcacgtgctggtgatgaccgccacgccgattccgcggacggtggccatgaccgtctacggcgacctggagacgtcggtgctctcccagctgccgcgcggccggtcgccgatcgcctcgcacgtggtgcccgccctggagaaaccggcctacctcgaccgggcctggaaacgggtgcgggaggaggtcgcggccggtcatcaggcgtacgtggtgtgtccccggatcggcgagggtcccgaggacgagtcgcctccgtcggacgacgagccggcccggcgtccgccgctcgcggtgaccgaggtgctgccggcgctgcgggacatgtatctccagggtctgcggatcgagatgctgcacggcaagatgccgcccgaggagaaggacgcggtgatgcgccggttcgccgccggcgacgtggacgtgctggtcgccaccacggtcatcgaggtcggcgtggacgtgccgaacagcaccgtcatgatcatcatggatgccgaccggttcggcgtctcccagctgcaccagctgcgcggccgggtgggccggggctcggcgccgggcgtctgcctgctgcacaccgaggcggtggagggttccgcggcccgcgagcggctggatgcggtggccgccaccacggacggcttcaaactctccgagatcgacctggagcagcgccgcgagggggacgtgctgggcgcgtcccagtccggcaagcactcgcatctgcggctgctgtcgctgctccgggacgagaaactgatcaaggaggcccgggtcgaggcggccgggctggtcggcgacgacccggacctcacccgctacccggcgctggccgcgtcggtcgccgcgttggtcgacgaggaccgcgccgagtatctggagaagggatgatcgttcacctctgcccccggtcggtctgggagtcggttgccgacagttacgccggcgacaccctggagtccgagggcttcatccactgctccgacccggagtgggtgcacgtgccggcgacgctgcgcttccgcggccgcaccgacctggtgctgctggagatcgacccggcgcgggtggacgtgccggtgatctgggaggagggcgtcccgccggggccggacgggcggctcttcccgcacatctacgggccgttgccggtcaccgcggtggtcgcggtccgcgacttcccgccgctgccggacggcagcttcgcgcccctgcgaccctgaacccgccccggccggcgccgaccaccggatccggaaacggcgagagcgcgccggccgatcggccgacgcgctctctggagtgcgctgtgcgttccgctgtcaggcggtgaacctcaccggtgtcaggcggtgaacttcaccttgcggcgacgggcgatgaagaacgccaccacgccgccaccgaccagcagcgccgcgatgcccgcgatgctgccggcggccgcaccggtcaccggcagggacgggccaccgctggggctgggcgacggcgtaccgaccgcgccgcacttgatgtccttgaccgcgaccttgagcggttccatcttgatgccggcgaagtccaccagggcgaacttgacgtcggtcagcttgaaggtcgccttctcctcggagtcggccttgaccgtgacggtcttggtctggtcgccgtaggtcaccttggcggtcaccggggtgacgtccttcgggttgtcgatcacgacggtcacgttggtgcagtcgttctggatggtgacggccggcagcgggcagtcctcgggacggctccagctgtaggtcttctcctccagcccgggggcgctgacggtcacgtcaccggcgccggccggaaccttgacggcctcggacttgcccgcggccaccgtgacggtcttggtctcgccaccgaacttgacggtgaaggtcacgtcgtacttgccgagcttgccgttgttggtgaggttgacggtcagctcaccggtgcagtcggagaccggggcgacggccggggtggtgcaggccttggagccgccgttgtaccagccctgcgggcccttggaccggccaccgaggccgctgccgctgcccagcttgcggtcgccgtaccgggcgccgttctgggtcatcgggttgatgatgtccttctcggcaccgaagaacaggtcgacctgggtgttgcagtccggggccgcgacgtcgagcgtggcggtgcggtgctggtcggtgatcgtgtccgaggcgtgctcgtactcgtactgcggccagttgtcgccgtccttgtcgctcgccttcggcgcgaagtacgagaccagggtgaccggctcgtcgttgcagagcttcgagtcgtcgtcgagcttgacgacggccttccacttgccgtcgaccagcgcgaaggtgtggtggaaccgggtggcggtggcctcacagaccggcgccggcggggtgcagtcctgcttcagctgcacgttggccgtgttgttcggcgacgactcggtgaagttgtccgtcggccacgtcgcggtgaaggacagctgcacctcggtgccgccgtcgaacacctgcgtgaagacggcctggccgttcgcgttgttctgccggcggggcagcacgtagccctcggtgagctcgtgcccgttcgcgtcgacgggcttggtcgcgccggcggggatcttgaggtcgttgaccgtcgcgtcggtgccgaagtcgttggtgagggtccaggtgacgacgttcttgccgtccgagccgcacgtggcggaaccggtgacccaggcgtcgtgggcactggcgggtgcggccatggccgcgacgcccgtcaggccgatgaccgcgcccgcgaggaggctagcggtgcggcgaagcgatgacttgattttcacgccttctcctgcggaggggaacaggggggactcacaggaagagaaacggagaccgctgtggatgggcagccggtctgcgacgacacctccccgcgccgtcgtgtcggcggcgtaccgacgacacagcggcgttgaccttagccaggtcccggcgccggggaaatagttaaggcctttccaagggtcttgatacgcattcgagatcttcagtcgacggtccggaatcccgtcgatgcgcagcgtgctcatacaagcccgcaattacggtgaaatcgcgcggcggggagcaatgcccgagcgcggccgccgacggttcatagtgggcggcgagagtggagcgtgggagagttccgcgtgggcccgtatcgccctggcgtagcgtcctggtgtgcttctcaggaacttcggcgggcgcggatgaccaggatcatcgcgggtgaccatggcggccggcggctgcagaccctgtccggtgcgcagaccaggcccacatcggaccgggtccgggaggctttcttcagtgctctggacaccatgacggatctgtccggagcgcggttcgccgacctctatgccggatccggcgcggtcggcctggaagcgctgtcccgcggtgccgaacacgtccttctggtcgaatcggacagcaaggcggcccgggtcgtccgggacaacgtggtggccctcaaggtcggcccggccgcgcgcctggtcaccggaaaggtgctgcaggtgctcgccgatcgcccggacggggggccgtacgacgtggtcttcgccgacccgccgtacgcggtgggtaacgacgagatggacacagtgcaacgagcgttgctggccggcggctggctggcgccggacgccgtggtggtgttcgagcgctccacccgtaccgagccgctgagctgggtggacggcctcaccggcgaccgcacccggcgctatggcgagaccacactttggtacggtcgccgatcatgagacgagcggtgtgtcccggctccttcgacccggtcaccaatgggcacctcgacatcatcgggcgggccagccggctcttcgacgaggtgatcgtcggagtgctgatcaaccagtcgaagtccggactcttcccggtcgaggagcgcctcgaactgctcagcgaggtgaccgcggcgtacgacaacgtccgggtgatgtccttccacgggctgctcgtcgacttctgccgggaccagggcgccgccgtggtggtcaagggcatccgcgcggtcagcgacttcgactacgagttgcagatggcgcagatgaacatcgggctctccggtgtggagacgctgttcatgcccaccaatccgctgtactcgttcctatcgtccagcctggtcaaagacgtggtcaagtggggtggcgacgcctcggcgtaccttcccgacccggtgctggcccggctggtcaaccggctgaagcagaattagagagacccgggccgcgtccggcgtgccggaacccggcccggcggcggcacagtaacgtgatcgcaccacgctgggtggcggttcgacgacgggagtgaggcaccggtggatccgctcgaccgtatcgacgagctcatcgagcacgtccaggacgcgcgttccgtgccgatgtcgcggacgaacttcatgttcgaccgcggcgagatgatcgaaaggctcgaggagctgcgcgccgagctcccctccgagttgcgcaaggcggccgcggtcctggacgagcgggaccggatcgtcgaggccggccggcgcgaggccgaccggatcatcagcgagggcgaggccgagcacgcccgcctggtgtcggtgaacgagatcaccgtgtccgccgagcacgagggcgcccggatcatcgccgaggcgcgcaccgaggcgcagcggctgcgtgaggaggtcgacgactacgtcgacaccgcgctggccaacttcgagcagttcctgaccagggcgctggcatcgatcgagcggggccgtgacaagatgcacgcgctccgggaaatcggaacattccagggtgaggacgctgaacgccctctcccgttttgacagcccgattcgacgacgtccggcaagctcaggtaatgttttcggtcggcctacccatggctgaggatcaagatgcccaagtcaccgcagagtcacctggatcccaggaagccgctggtcgtcgacacgacgaagctaccgcggcaacctggtgcgacgcgtgccctgaaacaggtggttccggcaccggcggacctcggcctggagttgatctcggtccctgagggttccgacctcgagctcgatctgagcatgacgtcggtctccgagggggtctacgtcagcggtgccgtgcggggctcgctcaacggcgagtgcggccggtgcctcaacgagatcgacaggtccttcgaggtgaccatcggggagatgttcgcgtacgcggacagcaccaccgaggagaccaccgacgaggacgaggtcggccggatgcagggcgacctgatcgacctggagccggcggtacgggacgcggtggtgctgaccctgccgaccaatccgctctgccggccggactgcccagggctgtgccccgagtgcggggtgcacttcgacgaccttcccgctgatcacagtcacgaggaagtcgacccccgctgggccgctttgcgcaatctatcgagtaacgaggagtaggaaccgtggccgtccccaagcgcaagatgtcgcgcagcaacacccgctcgcgccgggcgaactggaaggcgaccgcggtctcgaccgtggcgtgcccccagtgcaagtcgccgaagctgccgcacaccgcctgctcggtctgcggcacctacaacggccgtcaggtcctcgaggtctgacgtcgccgagtgactcgcccgatcatcgggcggctcgtacctgagcagtggcgttccaccggtgccccggttcccgcacgggagcggggcaccgcgcggatcgccgtcgacctcctcggcggggaccatgctcccgccgtcgtggttgacggcgctctgcgtgccgtcacggacgacccgtccctgcacctgaccctcgtcggcccggccgaagccgccgacgcggtgctcgccgccctgcatccggcgcagcgccatcgcatcaccgccgtgcccgccggcaccgccgccgaagcggtcgccgccggcctggccgacgccctggtctccgcgggcgacaccggccagaccgtgctcgccgcggcacgcgccctgggccgccgacccggagtccgccgccctccgctcgccgccgtgctgcccaccgccgccggccgcctcgtgctgctcgacgtcggctcgaccgtcgacccggacgagcacaccctggtcatgcacgcccggctcggcgccgcctacgccgccgcggtgcacgacgtccccgagccgcgggtcggcctgctcaccatcggcaccgaacacggcaagggcgaccggctgcgccggaccgtcgcgccgctgctggaggaactgccgctgcgctacgccggcctggtcgagggcggcgacgtcgtgcacggcttcgccgccgacgtcgtggtcaccgacggtttcaccggcaacatcctgctgaaagccctggaagcggcgcacgccggaaaacgatccgacgaggtgcgtgcggccgtactgctgggtgtccgcggcatcgtggtcgtctgccacggcgccgccaccggcccggacctcgcccagggcattgccttcgccgccgacctgcaccgccgagacgccaacgccgcaatgatgtcgtacaacgaggtatcgcatgaatgacaagcgccgccgtccccccaccctgcccctggaagaagccttcggcgtcccgttcgaggccgacctgctggaacgcgcgctgacccaccgctcgtacgcgtacgagaacggcgggctgcccaccaacgagcgcctggagttcctcggcgactcggtgctcggcgtggtgatcacgtcggcgctcttccacaaccaccccgacctgcccgagggtcagctcgccaagctgcgggccagcgtggtcaacatgcacgcgctcgccgacgtggcccgcggactcggcgacggcggcctcggcccgcacctgctgctcggcaagggtgaggagaccaccggcggccgggacaaggcgagcatcctggccgacacgctggaggcgctgctcggcgcgatctacctggagcacggcctggagacggccggcgaggtgatccaccggctgttcgacccgctgatggccgaatcggccggccggggcgccgcgctcgactggaagaccagcctgcaggagctgaccgcggccctcgggctgggcgtgcccgactacgtgatcgaggactccgggccggaccacgccaagacgttcaccgcctgggtggtggtcgccggggtccgctacggcggatccgacgggcgcagcaagaagcaggccgagcagcgggccgccgcggccgcctggcgaatgctcaccgagcggagcgaagcagatggcgacgacaagcccgagtaaggcggcgccggccgtgacggacaccccggagccgcccgccgccccgcagaccctgtgggagaaggccggcggcggtcccggggtcgccgtcgcggtcgggctgctcgcgctgacccgggtcggccagctcctgatgatctggtggctgggcggcgcgtcgacgtcgcacggcggggtgtggcagcggttgctggtctgggacggcggctggttcctgcgggtggcgaacaacggttacccgcacggctacacctacgacgagaaccacgtgctgcaggcgaacgagctcgcgttcttcccgctgtacccgtcactgatccgcgcggtgtcggcgctcggcgtggcgcccggcacggccgcggtcgcggtggcctggctcgcctcgatcggcgcagcggtcgcgctgcacctgctcggcaccacgctgtacggcaagcgggccgggtgggcgctggtggcgatctgctgttcggcaccggtgtcggtggtgctgtccatggcgtactcggaaagcctgttcctggccctcgtcgccggcatgctggccgccgcgcaccgccgcgcctggctgccggccgccgtactcggcctcggcgccgccctgacccgcccgaccggtgccgccgccgcgatcgccctggcggtcgccgccgtgatggccctccgtgacgaacccaacaggatcaaaccgctggcggcggccgcgaccgcgctggccggtgtccccctgttcctgggctgggtcggctggcgggtcggcgactggaccgcctggttcaagatccagacggcggggtggggcacgtccttcgactacggccgcagcacggtccgcttcctgcacgacacgttcaccagcggcgacggctgggtgcaggtcagtgtcggcctgatcctgctcgtcgccctggccgccgccggcgtcgccctggcccagaaaccgtggccgccactcgcggtctacggcgtcgtcgcgatgatcctcgtctacggccaggccggcttctaccactccaagccccgcctgctgctgcccgtactgttgaccctgctgcccgcagtcctcgccgccgcccgcgcccgcccccgggtcgcgatcctgtcgatcaccgcctgggccgccttcggcctctggtacggcgcctacctgatcaccgtctggccctacacgatgtgacggccgcacgccccgccccctatgccatgtgaggacccccgttgcctgagctacccgaggtcgaaaccgtccggatgggcctggccaagtgggtgaccggccgcaccgtctcggcggtcgaggtgcaccacccccgggcgatccgccggcacctgcccggcgacacccacttcatcgccatgctgaccggccgcaccatcctggacgtcgcccgccggggcaaatacctgtggctgccgctggactccggcgacgcgatcatcgcccacctggggatgagcggccaactcctgatgcagcccggcaccgccgacgacgagaaacacctgcgggtccggttccgcttcaccgacgacggccccgagctgcgcttcgtcgaccagcgcacgttcggcggcctgtccgtctcggagggcggcgccgacctgcccgccgagatctcgcacatcgcccgcgacccgatcgacccgctcttcgacgacgacgccttctccgcccgcctccgcggccggcacaccgaggtcaaacgcgccctcctcgaccagtccctgatctccggcgtcggcaacatctacgccgacgaggccctctggcgcgcccggctgcacggcacccggcccaccgacaaactgagcagaccggccgtcgcccgcctgctgcagcacgtccgcgacgttctcggcgaagccatcgtggccggcgggacgagcttcgacgagctgtacgtcaacgtgaacggggagagcggctacttcgaccgctcgctcaacgcctacggccgcgagggcgaaccctgcaaacgctgcggggcgatcatgcgacgggagagcttcatgaaccgttcctcgttcagctgcccccgctgccagcccaaaccccgcctgacacacgccgcctgacgcgagctgcctgaacccggctgcctgaccctgggctgcctggcccgcgccgcgccgctgacgggtgccgcgccagtaacgggtgccgcgccagtaacggaagccgcgccagtaacgggcgccgcgccggtgaggcgcggcgccggatgggccggggcgggcgggttacccgcgtaccgcggatcagtcggcgctgtgggcgccgccgccgggagcgccggccgggctcaggtccgggccggcgtcggtggccagaccgaagccggcgccgcggcgacccatcagccggcgtgccgcggtgagcagcccggccgggacgccgtggacgatgtgcccgtcgcccggtcgggtgccgtcgccgtcccagctctggtaggccgaccagggaccctcgaaggtgcagatccggacaccgaggtcgcggtagagggggtgggtcggcacgcccgggttcagcaccacccggtgcaggccgcggcgggcggcgaggcggacggtgagggccaccgggccgacgccgccggagccggccggggcgcggtccaggaacaggccctcgacgccgtcggcccgccaggcgtccacgtcggacaggacgtcggccagcgagcggctgccccagtccaggtcgatccggcccagcgactggtgcagggtgcgccggtcgccgggatgttcccggacgatccaggtgtcggcgtcgagttgcagctcggggccgggatgggcgtacgcggggaacagggtcttcacggagtcctccggaggtcggcggcggtcatcgaggcggcggccgggagcgcgaccgcgggcgggaaagtccggatcatgagttcctccgcagatcggcggcggtcaggccgacgatgatcagcccggccacgtgggtggccgccagtaccgccaccgccgctgccagcggcccggagccccgctgctgtagcagcggcatggccagcgtcgacagcggcaccgccgccagggtggcggcgatcccggtgcggttgcgggcggcgagcaggaaggtgatcgcgaagaccccgccgagcagggtgccggcagccagggcgaggaccgcgtcacggctgccggcggtgccggtcagaccggccggcaggcggtacgcggcgaccgccagcgccgcgccggcggccagcgggggcagcaggccggccagcgtgatcgcggtgacgttgcggatgtgccggttcaggtcgtcgacggatccggcggaatcgaggccggcttcgatgcgggcggtgtgccagccgatcagcgcttccaggatgggcaccgcgagcagcaggggcagcgccgccggggcgggggtgacagccggaccggatcgccagagcagggcgacacagaccgcctgggagatgccgatgaccaggtaggcgaggccgcgacggcgttcggccgcggtcaggcgcgggatgcggcattcgcggccgagcagcacggcggggcggaacgcccggatcaccacggcgacgaccgcggccggaagcagcgtttccaccgggacgtgccgggtccaaccggccccggcggcggtggcgagcacggcggcggccagcagccagcacgggatgtaccagaggatcaccgcgctctcggcgcgggtgaccagggcggcggtgaccgtggcgagcgcggcgagtccgccggcgccgaccgcggcggcgagcaggcggtcggggccgagcaggccggccggggcgatccagaccagggcgcaccagagcgcggtgacggcggcgaagccggcgccgatcaggcggaccgcggcttccggcccggcccgccgggcgacggtgacgccgacgctggtcagggcctgggcggcggcccagccgaggagcagggtgacggcggggacgggccaggcgacccggctgagcgcgccggccgcggccacggtgacgctgagcgggccgaggtagagcaggcagcgcaggatcaccgggagcaggaaggtcggggcccagcggcgtttggcgcgccggccggtgcggatctcggcaccgggttcgcggtcgccttcggcgaaggcgcgccaggcggcttcggcggcggctgctttggcgaggcgggccggggtcagctcccgcgagccttccggatccggcagatcgaacggttccgcggcgaagggttccgcggcgaagagttccgcggcgaagggttccgcggcgaagggttccgcggcgaagggctcgtccgcggcgaagggctcgtccgcgaacggctcggcgacgatcgactccgccatgaagggctcggcggcgaacgattccgcggcgaaggattccgcggcgaagggctcggcggcgaacgactccgcggcgaaggactccgggatgaagggctccgcaacgatgggggcctcggcgtcgcggctctggtccagctcccactgctggtagcgggcgttccaggcgccgttgggaatctccggatcggcggcgcgggaacgccgccgcggaacgacccgacccggccttccgctatcatactcgggcatttcgcccacattaaactcatccgggaacgcccactcccgccgaggtcgcggtgtgtctcccggaagcggctgcgccgcattccgatcccgttccacccaggcccgctgtccacgtcccgcgccgcggtggtccctctccccgattgcgcggtacgcgtgagcctcccccgccgtctccgcgggatcctcgccggtggtctcctccggctgggtggcgagcgcccgcgccagcccggcgaacagcagcgtctccgccgccccgtcgatcggcgaccggggctcctgcgcgtgccgcgccggcgtcccgaacaggaacgtctcggtcagcggcgtcacttcccgccgtggcggcgcatccggttccgcggcgacgttccacccggccggccgggtgaacaggatcgtctcggcggccggcagcccctcgaagtccgggttcgccccggccgcttcgggcgccggcgccgggaagagctgcgtctcggccggcggcaccgggtccccggcggccgggaacggcccgggctcgggggccggcggcggctcgtcgccgacggccggtttcacgaacagcagcgtctcggcgaccgccgtctcccgctcggagtccgacatcacctcgtacagccgcgcccccagcccgtcggtcgcggcggggccgtgctgacggcgtaccgcatcggcattctcctcgtagcgatccgggaggggaggccgccgccgcgcaccgggcatctcctccgggcccggcccgccgaacccgtgccggggctcgcccggcgccggcgcacgccgtcgccgggtgcgggcagcggtccgcgagcctcccgcggtcccgcgtgggggagtgatcgtcatttcagtcctccctggtcagccagcgcaacgtggccggggtctcggtccggggcgccggaacggcgagcgccagttcgaaagccggcgccgggggcggcgcggcaagatcggtgtagagagcgccgtacacccgcaccacccggtcgacggtgaagtggttcagcgcgcgctgccgggccgcgtcgcccagcgcccgccggcgcggtgtcgcccgcagcagctcgacgatcgcgatggccagctcggacgggtcgtcggcgggcaccaccaccccggtgtcgccgagcgtctcggccgccgggccgatgtcgacggccaccaccgggcgacccgacatcatggcttcgaccaggcggtacggcgggtcggacgggcccggcacgtgcgccaccacctggccgacggtgaaacgctcccgcgggtcggcgggcagcggatgcagccggatcgcccggcccagcccggtcaactcgatctggtcggcgcagtgctcctcgtgcgcggcggtcaccccgaccaggtgcagcacggcgcccgggagagccgccgccacctcggtgaacgcgtccagcaccagggtcagcccactgtccggaccaccgctgccggcccacaccacggtcggcggatcctccagctcggcagcgcccgggaagctcttcggatccaccccgaccggcacctgtaccagccgggtcggctcggcgcccagattgagcgcccagccgtggtggtacgcgctcagtggcgcgatgatctccgcctcggcatacccggtccgggccaccgcgctgcggaaccgccgcagcaccagtcggaccgcgggtgacaggcgttcctcggccggccgctgccgggtgaccggggtgcgcgcctcggtcagcagcagtggcgtgcccgtccgccaccggccggagagcgccgcgagcagcggcgtggtgccgcccacgcagtgcaccagatccacttcgggaaacggtacggcgagcgcccgcaacgcgtgccgcagcagcatggcggcggtccgggcgtcgcgcacgctgagcttcggcagggtgtccgggaccggctgcggcccccagcgccacgcgtccatcagcttgtcggccagtgggaggcggggcagcgggctcggccggttcaccgccatctccgcgatggtgcgcaaaccctcggcgaacacgtcggtcgcggtctcgtcgagcaggccgtgacagagctgggcgaccgcgtccccggcaccgccgggcaggtgcgcgcggcggcgctgggcaccggccggctcccggcccagcgcgacgacgcgcgacgaggcgacatgggacggaagcgggtaggcgggcgcggacggcagttcccggtcggtgacggtcagcagctcgaagcggaagcggtgcagtccttcgacgagcgaccggcaccatcctccgagggcgtcccggcggtacgggtatccgccgccggtgagcagacagatgcgctcgcgggacggggtcggattcacgctggaggcaacgacagaagacccccgggctagcggagcatgtcagctaggcgacagaaataagacccttatgtcctaatttgtcgtccatgtttgcccgtttttgcccgaaaggccacggtgttcggggggtagtgcgcggctgctgcgggtgcgatgggtggcgggcatccggccctggcgttctcggcgggtgatgccaccattcgcccacggcatcgacagatgatggcccgtcggcggcgtgggtggcgcgcagtggggtgggtggggtcggtggttggtgagcggacgcgggattttcctgatcaaatgagtggcccgcaggtgtcaccgacgcgtacggtgttgatcgaacttcgtcgagtgagatgatcgggcagtgtctcactgtgggcgacaaaaccgccttgaacacgcaaattcgctgttcaagaacccctggtggcgtgattcactaacgtcggccgcgctgctgcatgcgctcggcttgacggagtaggggtaggggcggactatggaggggtcgccagtcgcgcccactcatgccccggcccgcttcgtggcttgagcttaagcacctaaaggattccaccacagcagtggcgggattctgtgctcacgcgtgcccgtgagtgcttcggtgcggcagtttgcgctgggcgcgtcatggccggccgttcccggcgaagcatttcatatacgagacgcaccgcgtcacaaggagtcacgatggcgaaggccctctacggccacgtaggtgcggcgcccgatcggcgcctgctcgacgaggtcacccgactgcgttccagggtgcaatccttggagttcgagatcacccgcctccgggcggagaatgatcgtcttgcggcggcggccgccgaggcggacgacattctgcggctgaccgagccggccctgacctgagctccaccgaccgccgggacgtttctgcggggtgactgaccggcgatcatcccccgaatgcaccacaacgcatcaaagaaaagcgcgcctccacatccgtggcggcgcgcagttttttgtgcgggatatgagaacggcaaaggccacacgcggatggtcagcgtgacaagcaccacgcgtgatcacgccatggcgtagcgcattatcgagaaccgcaaccgccccttccgcgggcggagccgaacagtggcagtcccgttgcgccggccgccaccgaagatgccggcgacacgggccgcgatccggtcgccgggcgcgccgccggatccgattggggcgcgcggtatgcgccatgcgggcacggatcggacggcgtgcgcggtaacacgccccgcgggcacggcgcgccgccggtgccgggctgcggcgtgctggaggaacccggcttggcgggatcgcgccgggtgcactcccgcggtgcggagtgccggcgtcggtggtgcggtgaaggtgccccgggatgccgcgcgcggagcgcgccgtgcgggggaaagggtggatattccgggtggcgcgcggagtcgggcgcgccgtagcggtgcctcacgcaacccgtgcgggtagcctgccacccagcaggagaccgttgaccaccggcaaggcacaccgctgaccatcttgtggaagtccgccgaaccggagaaagattgccgaccttcagcagactgccgaccctcggagatccgtgcacctcaagagcctgacggtgaagggcttcaagtccttcgcgtccgccaccacgttgcggctggaaccgggcatcacctgtgtggtggggcccaacgggtccggcaagtccaacgtcgtcgacgccatcgcctgggtgctgggcgagcagggggcgaaggcgctgcgcggcggcaagatggaggatgtcatcttcgccggcacggccggccgggcgccgctggggcgggccgaggtgacgctgaccatcgacaacaacgacggcgcgctgccgatcgactacaccgaggtgtcgatcacccggcggatgttccgggacggcgccagcgagtacgagatcaacggcaactcctgccgcctgctcgacatccaggaactgctcagcgactccggcatcggccgggagatgcacatcatcgtcggccagggccggctggacgcgatgctgcacgcgaagccggaggatcgccgctcgttcatcgaggaggcggccggggtcctgaaacaccgtaagcgcaaggagaaggcggtccgcaagctcgacgcgatgcaggtcaacctgaaccggttgaacgacctgaccgccgagttgcgccgccagctcaagccgctgggccggcaggccgaggtggcgcgccgggccgcgggcatccaggccgatctgcgcgacgcgcggctgcggctgctcgccgacgaccttttcaccctgcgtacgacgttggaccgggagatcgccgacgaggcggcgatgaaggaccgccgcgccgaggtggaggcggagaaccgggaggtccagcggatgctggccgacctggagttcgcgcacgccgaggacgcgcccctgctgcaggccgcgcaggacacctggtacaagctgtccaccctgcaggagcggttccggtcgacggagcagctggccaccgagcggctgcggcacctggccgccaccccggacgacgagcggccgggccgggacccggacatgctggaggccgaggcggagcgggtccgcgagcaggaggaggagctccgcgaggcgctcaccgacgaccagatgcggctggccgaggcggtcgagcaccggcaggacctggagcggcagctggccgcggccgagggtgagctgcgcgccgccgcgaaggcgatcgccgaccgccgcgagggtctggccaagctggtcggcaacgtgaacgcggcgcgggcccggacgtccagcgcggccgaggagatcgagcggctggccgccgcgcacgaggacgcgctgatgcgggccgaggcggcacaggccgaggtcgacgtggtcgccgccgagtcgtcggacgccgaccgggacaacgccgatctggacgcccggcacgacgaggcggtggccgcgcacgacaaggcggccgccgtggtccgcgagctgtccgacgcggagcgggccgcggagaaggacgcggccagcctcaaggcccgcgaggaggcgctggcgctcggcctcaagcgtaaggacggcgccggcgcgctgctggccaaggccggtcaggtgccgggtctgctgggcagtctggcgtcgatgctctcggtgcggccgggatacgagacggcgctctccgcggccttggacacgctcgccgacgcggtggcgctggcgagtctggacgaggcggtcgaggccgtccgtacgctgaagatcgcggatgccggccgggccgcgctggtcatcgccgcgccggccgggcccggtatgcagggatcgctggacgccttgcgtccggcgttgccggagggtgccctgtgggcgcccgacgtgatcgactgccccgagcagatccgcccggcgctcaaccgcgccctgcgggacgtggtgctggtgccggatctggccgcggccgccacactgatcgccgggaacgccgagctgcgcgcggtcaccccggagggcgacgtgctcggggcctgggccgcggccggcggttcggcgaaggcgacgagctacatcgaggtgcaggccgcggtcgacgaggcgaaggccggtcgggccgccgccgaggagcggatcgccgagctcaaggagcagctgtccgaggtccgggcccaggtcgccgagctcaagcaggcggtgcaggtcgcggcccaggcgaagcgggccgccgagggcgagcgcaacgcggccgcccgccggctggccgagttgggcgccgcggcccgctcggcgagggcggagagcgagcggctcggcgcgtcccggcagaaggcggaggcggcccgggaggccgacctgatgcgggtggccgagctggaggagcggctgcggctggccgaggacaccccgatcgacgaggaaccgtcgaccgaggagcgcgaccggctggccgcgctggtgccgcaggcccggcagaacgagatggaggtccgcctcgcggtccgcaccgccgaggagcgggtctcgtcgatcgccgggcgggccgattcgctgctgcgtcaggcgaaccaggagcggctagctagctagcggggtgcggagatcgcgcgggcggtcgcggccggggcgggcaccgcgctggcccggttgaccggatcgctggtcgccgcggccgagacccgggaccggatcgcgcacgagcgaaccagtcgcgaggccgagctgcaggaggtccgcgccaccgcgaagcgcctggtcaccgagctggagcggctgaccagtgaggtgcaccgggacgagatggcccgggccgagcagcggatgcggatcgagcagctggaggtcaaggcggccgaggacttctcgctcgacgtggacaccctgatcaccgagtacggcccggagcagccggtgccgccgacccaggccgaggtggccgccgcggagcgggacggcaagccggcgccggagccggtcccgttccaccgggccactcaggagaagcgggcgaacaaggcggaacgcgacctgaccatgctcggcaaggtcaacccgctggcgctggaggagttcgccgcgctggaggagcgtttcaagttcctctccgaccagctggaggacctgaaggcgacccgcaaggacctgctcaccgtggtcaaggacgtggacgaccggatcctcgaggtgttcacctcggcgttcgaggacaccgcccgcgagttccagcaggtcttccaggtgttgttcccgggcggtgagggccggctgatcctgaccgacccggaggacatgctgaccaccggtgtcgaggtggaggcccggccgccgggcaagaagatcaagcggttgtcgctgctctccggtggggagcgctcgctgaccgcggtcgccatgctgtgcgcgatcttccgggcccggccctcgccgttctacatcatggacgaggtcgaggcggccctcgacgacgtcaacctcggccggttgattacgctcttccagcaacttcgggagaagagccagctgctgatcatcacgcaccagaagcggaccatggaggtcgcggacgccctctacggcgtcaccatgcgagccggcgtcacgcaggtgatcagtcagcggctcaaccgcgacacggaggattagaagagaatgcgcgaccgcgcccgggccctgctcatcgacctggacggcgtgctgcgccgcttcgacccggccccgatgatcgccgtcgaggtgaggtacgggctgaaaccggccgccctgctggagactgcgatgtcgtgggacatctaccggcccgcgatggccggcgagatcaccgacgaggagtggatgcggctggtcgccgaccggctgccgctggagcccgccgaggcggccgccgcggtggccgagtggcagccggcccggctcggcgaggtggacccggacgcgctggagttcgtccgcggggtgcgcgccgccggccgcccggtcgggctggccaccaacgccaccgaccggctgcgcgccgacctcgacgcgctcggtctgaccgccgaggtggacgtggtgctcagctcgtgggagatgaaggtgcacaagcccgcaccggagtacttcgagcaggcgtgccaggccatcggcgtaccccccgggcaggtgctcttcgtcgacgatgacgaccgggtgatccggggcgcgcggtcggccggtctgtccggatatcggtgggccggtaccgagcatgtgccgtatctccggaaagcgctcgacatcgattcgtgaccggaatccggaacgatggggcgcatgtcggcttttcgcggcttgaccgcggtgctcctgctcctgggtgtggcggcgtgcgacgtcgcccacgacggcgagccgctgtacaccgccggcaccccggcgccggcgggaagcggcccggcgccggccggcttcgcgccggtcggcccgggtgaccggatccagccggggcggcagctcaccttcgcgaccgtgcagtccggcggccggtggatgctcaccgtcggcgcggacggggtcgtggtgctcaccgaccatctcgtcgaccaggcgctgttcgtggtcaccgagaccacgccgggcgccggccggttcctgctgaagacggcgaccggcgagcagtcctgcctgcaggtgcactcgccgggcaggggcagcgcgctgcggctcaagacggcgccctgcgacccggcccagcacgatcagatcttcaccttcccgctggcgcacgacggcaagggtgtgctgatcgaggtgaacggtctctacgccttcgccgccaccgacggcggcccgctggtggtgcaggagagcggcgagggcgacgcgatgaccgccttctccgtccgcgaccagggccccgcctaactgccggtgacgccgtcgatccgctcgcggagcaggtcggcgtggccgttgtgccgggcgtactcctcgatcatgtgggtgtacacccagcgcaggctgatcggcccgcgccggcccgggaactcgtgctccagcggcagctcggccacggccgcgtcacacacctcgatctcggcgaggaaggcggcgaagttggcctccgcgttcgcccccggcacgtcgtcgaagtcgccgtcctggttgtcgtcggtgcagtagacgtcgcccaccgtggggtcctgcagcgtgcggttgcggaaccaccagcgctccacctcggtcatgtgccggaccaggccgagcagggtcagccgggacggctcggcgctggccagcttgagctgctcggcggtcaggccggcgcacttgagcagcagcgtctgccggtgatagtcgagccagccctggagcatggcgcgctcgtcgccggtgtgcggttcgggtacgcggtgcgcctcgggcgcggtccaggtagtcatcgacgccatcctggcgcagcccggcgcccaccgcaccccgatttcacggccggtacgtggtcgccaccacctcgtgcagccgcccgtccttggtggtgccctcgatgtgggtccgcgcggtggcgccgtccaggatcagcgtgccgatcgcgttgccgaagtacggcccggagagccgtttccaccggatcagcggcttggccgccccggccgaccgggccagcccacgggcgacccgggcgaccggtggcagccagctgacccgcatcagcgggcgcagcggcaggggcacctcgttgtggatcggggaacaggtcagctgcatcaccggggtggccatggcgtgcccgaagtcggcccgggccacgtacgagtggtgcacgtccccggagagcacgctgatcgacgcgggcgccgcgtacgccccaccggcgccgacccggtgcccgggcgcgcccacgccgccctcaccgagccgccggaacagctcgccgagcgccgcgaacgacttgccgaacgcggcccagtgctccaggtcgaaggcgcgccgcaccttctccccgaaggccgcccagcgcgggctccaggactcggtgatcgcctcgttccacgcctccaggtggtggatggcgggcggcatcagccacggcagcgaggagccgatcaccaggtggtcgtagtcgccgtgggcctggtcgaggaaccagtcccactcggcggccggcagcatcgcccgggcgcccggggtgagcacccggttgcacctgttgtccagcaccaccagccgggtgcggcccaggtccagcgcgaagctccactggtagggcacgtcggtgttctccgccgagcccgggtcgtcgaccgccagcccgaactcgcgcagcaggtcggtggcgtctccggcgaccgacaccttctggaacagcgggtcggcgtccagctggtccgggctcaggttgcccaggtgctgatagacccagtaggagccgagcccgccggcgatccgctcccgccaccacggctgccgggccatgtcggcccgccaggacgccgaggtgttccagtcgtcgatcagctcgtggtcgtcgaagatcatcacgctgggcacggtggagaacagccagcgcacctccgggtcgcgccacgactccaggtagagcttcgtgtactcctcgaaggtgaccacctggtcggccggcccgtcgtgcccggccgcgcggcgccggcgcaggaaccggcgcaccttgtgcgaggtctcgtcggcgtacacctggtcgccgagcagcaccagcaggtcggggcggtgctccggctcggccatcaggcgccgcgcgtacgcgtccagcgcgtccggcggcagctgccgcccggtggcctgcggggtggcctgccggcacgagccgtagagcaggctgaccggctgcgcggcgtcgtcggcggcccgggtacggatcaccgagggcgggtacggcgtgccggcgaccggccacacctcacggtcgtcgagcagcacccggtacgcgtgcgcggcgtccggggcgagcccgccgaccaccaccagggcgtagtggtgcccgtacgccgagaaggtcggggcggacccggcggcgccgccgtcggtctcgacccgcacctgcgcgggggcgctcgtctccacccagatcgtcgcgcgatcggcgacgacccggcggagcacgggcccgatgaggagttgcgcggtcacggcaccggccttccaatggtctgggggtgcccacatccttcccaatgaccaccccgaatcgccagtacgtggcccacgccacggccgggcggcgcatctgtcaggatttcggcatggaatacgtggtcaccgcattgatcctgctggtcgtcctggtcgtgggcgcggtgggactggtcgtgccccggatgcgccgcaaggagcttccgccgccgacggttccgcaggtgcccgcggaacaggagctgccgccgctcatcgagaagccggtcgagccggtcgagccggtcgaggtggttcaggagccgccggcgccggtcgtcgagacgcccgagccgaccgccggccgtctggtccggctgcgggcccggctggcccgctcgcagaccgccctgggccggggtctgctcagcgtcctctcccgggaccacctggaggacgacgactgggaggagatcgaggacagcctgatcaccgcggacgtcggcgtcgaggccacccaggtgatcgtcgcgcggctcagggagcgggtccgggtcctcggcacccggaccgtcgccggggtgcgcgagcagctcgtcgaggagctggtcgcggccctcgaaccggatctggaccgcagcctgcggaccgccccgcacgacggccgccccgcggtggtcatggtggtcggggtcaacggcgccggcaagaccaccacctgcggcaagatcggccgggtgctgatcgccgacggccggaccgtgctgttcggcgcggccgacacgttccgcgccgcggctgccgagcagctggccacctggggcgagcgggtcggcgcggagacggtccgcgggccggagggcggcgacccggccagtgtcgcgttcgacgcggtcaagcggggcatcgacaccgggatcgacaccgtgctggtggacaccgccggccggctgcagaacaaggtcggcctgatggacgagctcggcaaggtcaagcgggtggtggagaagcacggtccggtcgacgagacgctgctggtgctggacgccacgaccgggcagaacgggctggagcaggcccgggtgttcaccgaggtggtggatgtcaccggggtggtgctgaccaagctggacggcaccgcgaagggcggaatcgtcatcgcggtccagcgcaagctgggtattccggtcaagctggtgggcctgggcgagggcccggacgatctggcgccgttcgaacccgcggccttcgtcgaggccctccttggggagaccgcgtaggctcggtcctgtttcaccggacatttctcagggaggccgtgggtgacgcaggagccgctgcgcgagataccgctgcacggtggcaacgtcagcacggtgtcccgggtcggtgacacggtccggcgtaacgccggaccgtggacgcccgccgtccacgcgctgctcaaccatctggagcgggtcgggttcaccggctcgcccagcgcgctgggcatggacgagaagggccgcgaggtgctcacctacctcgacggcgagtgcggggagtatccgctggccccgcactgggtgaccgaggaggcgctggtcacggtcgccaccatgctgcggatgttccacgacgcgcagtacggcttcgtgcccccgcccggcgcggtctggcgctcgttcggcccgccgccgccggacaccgaggtgatctgtcaccacgacgccgccccgcataacgtggtctggcggccggacggcacgctcgcgctgatcgacttcgacttggcctcgcccggctcccggatctacgacgtggcctacgccgcgtggacctgggtcccgctgttcagcgaccgggattcgtacacgctgggctggaaacggccgaaccggccgcgccgcctgcggctgttcgccgacgcctacgggctgatcccgcgcgaccggcaccggctggtccgcaccataaggaaacggatcgtcgaccacgtcgagggaatccgccggatggcggccgccggcgacccggccttcgtccggatcgtgcacaaaggacatctacgcaggccgatgcgggatctccggttgctggattacgaacggcacaccctggagtacgccctccggtgatcaacggcttgtgagagtttcttcacacgtcggaaacaacccgtgacgcgccggaaatcgcgcgtagaccgtgctcgaaacagccagccgacacagtctgcgtcgaaccggccgacacggcgaagctgcccctcggtcgcgtgttggagaggacacctgatccgagaggaggcagagcgatggacaccggtaataccgcgtggttgctcctgtcgtctgcactcgttttgctcatgacccccggcctggcgctcttctacggtggcctcaaccggtccaagggcaccctgaacatgatgatgatgagcttctccagcatcgggatcgtctcgattctgtgggcgctctacggcttcagcctctcgttcggcgccagcggcaacgcccgcctgaacaacatcatcggcaacctcacccagtacggcggcaccgacatcagctgggccggtgacctctggggcaccacgaagatcccggtctacgtcttcatggccttccagatgatgttcgccatcatcacggtcgccctgatcagcggctccctctcggatcgcctgaagttcggcggctgggtgctcttcgccatcggctggttcaccgtcgtctacgtcccggtggcccactgggtctggggcggtggctggatcggggcgaaactgcacgccctcgacttcgccggtggtaccgcggtgcacatcaacgccggcgccgcggcgctcggtgtgatcctggtcctcggcaagcgggtcggctggccgcgggacaacatgcgcccgcacaacgtcccgttcgtcgccctcggtgccggcctgctctggttcggctggttcggcttcaacgccggctccgagctgaccgtcgacagcgtcaccggtgtcgcgttcgtcaacacgcagctcgccaccgccgccgcgctggtcggctgggtcgccgtcgagtggatccgggacaagaagccgaccctggtcggcgcgtcctccggcgccgtcgccggcctggtcgcgatcaccccggcctgtggcttcatcgccccgctgccggccgtgctgctcggcctggtcgccggtgcggtctgcgccctggccgtcggcctgaagtaccgcttcggctacgacgactcgctcgacgtggtcggcgtccacttcgtcggtggctggatcggctcgctctccatcggcctgttcgccaccaacaaggccaacagcgcgatctccagcgcgctcggcgccaaggacggcctcttctacggcggcggcttcacccagctcggccggcagttcgtcggcagcgccgcggtcaccgtgttctccctggtcgtggcggccctgatcgcctacgtcctgaaggcgatcaagctgctgcgggtcagcaccgaggcggagatcggcggcatcgacatcgccgaccacggcgagagcgcgtacgacttcaccccggccgccgggtccggtggcggcagcgccttcgccctggcgggcctcggggcggccaggacggtcgacgccgacgggaaggctgacaccagccagaaggtcgccggttaatctcactcatggctgctgaagtggaaggactgagcatgaagctggtgaccgcggtcatcaagccgtaccagctcgacgcggtgaaggaggctctgcacgccctgggcgtcgccgggctgaccgtgagcgaggtgcagggatacggccggcagaagggccacaccgaggtgtaccggggcgccgagtacaccgtcgagttcctccccaagatcaaggtggaggtgatcaccgacgagatcgacgtggagaagatcgtcgacgcggtggtgaccgcctcccggaccggcaagatcggcgacggcaaggtctgggtgacgacagtcgacgacgtcatccgggtccgcaccggcgagcgcggcctcgacgccctctgatcccatgaccaacccgttgagtgagcccccggccccgcccgcacggccgacggccggtggctcgctcgacaaactgcgcgaccacatcggggccgcggcacgcgacgagcgcgccgcggctctcgacgtctggctgcgtcagctgttccccagtcacctgcccggcgtcagcctgctcgcggtgggcgggctcggtcggcgcgactgcgcgccgtacagcgacctcgacctggtgttggtgcaccgcggggtggccggcatcgaccggatcgccgccgcgctgtggtatcccatctgggacgcccggctcggcctcgaccactcggtgcgcaccctgcccgaggcgctgtcggtcgcccacgacgacgtcaaggtcgcgctcgggctgctcgacgcccggcacgtggccggcgacgagacactctccgccgagctgatcgcggccaccggcgaccagtggcggcgcaccgccgtacgcctgatgccgcagctcaaggagctcaccgagacccgctgggcgagccacggcgaactggccttcctgctcgaaggcgacctcaaggaggcggccggggggctgcgcgacgtcaccctgctgcgcggcgtcggccgggccgggatcgccgacaccatgcgtcccgcggtgcgcgccgccaccctgcggctgctcgacacccgggacgccctgcacctggccgtcggccgtcgcgtcgaccggctggtcgcccaggaacgcggcgcggtcgccggcctgctggagatcgaggatccggacgccctgctgcgccgcgtctccggcgacgcgcggaccgtcgcgcacgcggtcgacgacgcctggcgggcgatcgaccggttgcgcggcacccgccgccgtggcggcatcccgtccgcaccgtcgcgccgcccggtcgcccgggacgtggtcgagcaggacggcgaactcgtgctggcccgcaccgcgatcggcccggtccccgaccccagcctgtccctgcgggtggccgccgcggccgccaccgtgcaattgccgatcgcccgggccacctgcgagtggctggccgcgttctgcccgccgctgcccaccccgtggccggccgccgcccgcgccgccctggtctcgctgctcggcgccggccccggcctgctcccggcctgggagacctgcgaccggtacgggctgatcgacgcctggctgcccgagtgggcccggatgcgcagcctgccgcagcaccacccgatccaccggttcaccctggaccggcacctggtgcagaccgcttacgaggcgacccggcacgcccgtgaggtggaccgccccgacctgctgctgatcggtgccttcctgcacgacgtcggcaagggcctgcccggcgaccacagcctcgtcggcgccccgatcgccgcggacatcgccacccggatcggcctgccaccggccgacgtggccaccgtcgaacggatggtccggctgcacttgctgctgcccgacatcgccacccgccgcgacctgagcgacccgaagaccatctccacggttgccgagcaggtcggcgacccggccaccctggacctgctgcacgcgctggcccgggccgactcgatggccaccggcccggccgcctggtcggactggaagggccggctgatggccgagctggtccgccgggtgcacaccgcgctggacaccggcgccctgccggagccgccggaacccgatccggaactgctcagcggcaccctgccggtggtgcacctggacggcgaccgggtgtcggtggccgcggccgaccgtcgcggcctgctcgccggggtggccgcctgcctcgccatgcaccggctggacgtggtcgcggcgaacaccggcacggtggacgggcgggcgatcgtcgaattcctcacccagccgcggtacgggacgccgtacgagccggtcgcgctcgccgccgacctgcgccgcgtcgcgtcgggggacgtctcggtgacccagcgggtgcgggcccgggcgatgagcgcccgcggtggcaccgccgaaccgaaggtgatctggcagcgggccgcggccaccggcgcggtcgtcctggagctgcgcgccgccgactcgccgggcctgctctaccgggtgaccgcggcgctggacgaggccggtgcggaaatccgggcggcccgcatctccaccctcggcggcgacgtggtcgacgcgttctacctggtcggcgactggtcgtcggacagcgaacgggaccgggtgcgcgacgccgtgctgaccgcggtgtaaccggcgggccgcgacgaccgttgtagaacccgatgatcgggtcactgctggacgaacaaccggcgacgctggtcgccgccgcggtgcgcaaccgcgccgtcggcctccgcgacgagctggcctatgccgggctgcgcggcaccggcacgttgagccagctgctggccgccgcccgtgccgggcgccgcgactggctgcgcgaacggggctgggcggtgcaacccgcccggctggcgatgctcgcgcagatcatcgcgctgcaggacgtgctgcccggcgaccgggccgacgcgctggccctcttcgagctgctcggcccacgggcggtgccaccccggcagcgcgccgtctacgcccagctggccgggtccgcccggatgcgggtggaccggcaggtgcgccgggagatcgccaccgacctggccaacccgttccggcatcccggccggtcggtgcgacggtggctgcggcgcttcaccgaggggctgccggagcccgcggtccgcctggacgaccgggccgacctgccgcccttcgaccggctgaccacggccgcgccggcgccgatcgagcggccggagaagatcagcgtggtggtcaccgcgtaccggccggacgagggtctgctcaccgccgtccggtcgatcgtccggcagtcctggcgcaacctcgaaatcctgctcgtcgacgacgcctccgggcccggattcgacgacgtgctgcggcgcgcggtggcgctcgacccgcgggtgcggctgctgcggcagaacgtcaacgccggcacctacgtggcccgcaacgccgggctggacgccgccaccggcgacttcgtcaccttccaggactccgacgactggtcccacccgcgccgcctggagctgcaggtcacgccgctgctggccgatccgcgactggtcgcctgcacctccgacgggcgccgggtcaccgccgacctcgtggtcacccggctcggccggcgcggcggcaaactcaacccgtccgcgctgctgctgcgccgcaccccggtcctggaccgggtcggctacctcgatgtggtccgcaagggcggcgactccgagtacatcgagcggatcgtcgccgcgttcggcccgcgcgcggtccgccacctgccgatccacctcgcgctgatccggctctccggcggctcgctgtcgcgcgccgagatcctgccctactggatccacccggcccgcgccgtctaccgctccggttacgtcgcctggcaccgccggatcgcggccggcgccaccccggcccaccggccgcgcgacggcgcgaaccgacccttcccggcgcccgcccacctgttgcgctccgatcggattcacccttcgattgccgcgtacgacgtgatcgtcgccgccgactggcgcaccctcggcgagagccagcggtccgccctcgccgagatcgacgccctgctcgccgcccggatgcgggtagccgtcctgcacctggaggactggcggcggcccgcccgggaacggatcccggtacaccgcaccatccaggaccgggtcaacgccgggcggctcggccaggtcgccctcaccgacgacgccgagtgcggcctcctgctgatccggcaggccgagctgctccgcttccccccggccgaactcctctccccgccgtccccaccctccgcgtcgcccaccgttccgggaggtggactgcgtccgggccgggtgctggtgctggtcgacgaggagccgagcggggcggtgcggccggtgccggtcctcggcgccgaaccgctgtggtgcccgcaggggccggacctgcgtgcggccctcaccaggctgccgctgaccgatttcgacctccccacggtcgctgtggcgcagtccctgccggggcggtcgccgtccgcacggccggtggtcggcgccgagatcaccgaccggcggcagctggccctcctggaccggctgaccgggatggacgtccggatccgggtcgccgacggggtccacctgccccggcagccggccggccggctcgtctaccgcaccgcggacctcaggtcgctggacttcctggcccagctcgacttctacctggactcggtcggctcgcggcggtcggtgctggacgccgtggcgatgggctgcgtggtgctgaccacggtcccgggcccggtcgggctccgctgccgcccggaccgggtggcgggggccatcacccagatcgtggcggatccggaccgggccgccgaacgactccgccaggaccggtcgacgctgcgcaccgcccacgatccggccctgttcgtctcgcgggtggcggcgctgctgtcagccaccacctcggagccggcaccggacatttcgggtgctgcggcatcggacccgggcacctcgggagtcgtcgacccgggtgctgcggcatcggacccggccacctcgggagtcgtcgacccgggtgctgcggcatccgacccggccacctcgggagtcgtcggtgcgggggccgcggcttcggatgccgcgggggccccggtgctgccggccgaggcgggggcggcggtgcgtaacgctccgtaggttgcgccgttaggggatggagtggtcgcccccgcggccgcgcgcaggcacgggaggtggcagttccatggtccgcaaactacgccggctggccggccgggcacgggctctcggcccgctcaccatcggcgccgtggtgatcacctcgctgctggtcgccgcggtcaccgtggccgccgtgtacgacgcggcccggatcgcggtctgcctgctcgcgctgctgctcgcggtggcggtggccggggtgctccgggtcaacctgcggctggccgggatgcgggccgaccggcgggagatccgcgacctgcgggtggtgctcgaccagacgcagcgccgggtggtgtccgcggtcgaacgccagcggctcaacaccgaggaccggcaccgggaactgttcgacgcggtggcccgggtccagcggatcgccgaccgcggtgtccgggacctgcggttcgccgtgccccgcgaggtggaggcgaccgtgcagctcttccaggggctgaccccgcgcgcgccgatgccgtcctccggcgacttcgcgctcaacccgaccgacctgctggagctgctcttcctggtccgcacccggcggccgcggctggtcctcgaactgggcagcgggacgtccacggtgtggctcgcctacgtgctcgaacaggtcggcggccggctgatctccctcgaccacgacccggactacgccgcccgcacccgcgccgcgctgcgggcccacgggctgaccggggtcgccgaggtccgcgatgccccgctcaccccggtcgagctgggcgagcggtccttcccgtggtacgacccggccgccctcgacgacctgaccggcgtcgacctgctgctggtcgacggaccgccggccgcggtcggcccggacagccggtatcccgccctgcccgtcctcgaaccccgcctcgccgaccgcgccaccatcgtcttcgacgacgcgaaccgcagcgatgaacaggccgccatcgagaactggctggccgccgtcgacggcctcgcccgcgaaggcgagctgctcggccgccacgccgttctctcctacgaccgctccaccagactcaccacagctacggctaccgcgccccgctgacccgcgccaccgttcggccgcgcgccgtcgcccgcgctgccgatcggcccacgatcatgggcggcaggcaaagaagcaggcccccgccgcagggggatcggcgggggcctgctcatgggccggcaaagccggcttgcttggggattccgcgaccaacagcggatgtggaagggctgggcgattgtcctgaacgcgacagcggccaaagcgctgtgcccgctcgcccccgatgggcgacgatcagttgtcggccgcggcgcacgacatctgctgcgagcattcgaccttgcttccgaccgtcagattccgcctggcccggccggatcagtaaccgaagtcctgcgtgaagtagggtgcgccgcccttgctgtagatcgcgcccactcccaccgtcttcgactggcagttgaggatgttggcgcggtgtcccgggctcttcatccaggccgcgacgacgtccttgccgctgcggtatccccaggcgatgttctccgcggacggcttcgggtacccggcggccttctcgcgggcgacgaagtcggagccgcccttgccggtgtggctgaacgccccaccctgagccatgtacgcgctgtgcccgcgagccgcggtgatcagccgggcgtcgaccttcagggcggcgcagccgtgcgcggtccgctgggcgttggtgagcttgacgatgtcggcctgcagcgtcgcctcggagactccggcggcgtcggccggggtcgccagcagcgtgacgccgagggcggcggccggggcgagggcggcgacgacggcaaggcggcggaacagcgagcgcaagatgatccctttcggaaagcggcgcccggcttgtcgccgggctcaccgttcccttcggcgtcccctgtcgcagcgatgatcgcggatcgggagtgcccgggtcgccgatcggttgccgccctccgcacccgttccacaacttgcggcagcagtgcgcgccccgtgccgcgaccgcccgctgccgtgcccgccctgccgtgtgcccctgcgtcgtgtccgccctgcgtcgtgtccgccctgtgccgtgccccgctgccgtgtggcccgccgggagtcgcgggcggcggacggcgcggtcgtggcgggtcagccggcggtgcggggcttcggcagctcggccgggcgtagctgggtcaggaccgcgtcggcgtacacgccgtggtggtggcggcgggcgaagtcgcggccgcggccgctctgggctgcccagcgttccgggctgcggtgcatccgccgcatcgtcgggtgcaggtcgtccggggtgcagtagacggccgctgagccgtattccgcctccctctccggggggagcagcaggacgcagccggcggccagggcgggcagcagggtggccggggggtcacccaggccgaggtagaagtcgatctggtgcaggaagccgcgcggggtgacgtccggctcgcggtagacgagccagttcagcggggtgcgccggccgaaggcggtggtggcgtcggcggaccggtccagcacgcggacgtcgcattccggggcgtcgcggaccagtcggcgcagggttcgcaggtggtcggggccgtcagcggtggcccggccgaggatcgggcggtcgccggcgggccgggtgcggaccgcctgccagcggcgcgggtcgacggtgcacggcagtgggacggtgaccggttcgacgccgaacaggcggatcgaggcggcggtcagcgcctccgcggcgggggaccagtccggatcgtgctcgatcacgacgtggtcggcgctgatgccgctgggcaggccggcggcgaaagcgatcgcggccgggccgcggaccaccagaagccgggtgtgcgcgcggtcggcgaggaacacctggcggacctcggccaggttgatcatgcgttggacctccgggtcgaggttgcggccggcggcgtcgagggtgggcaggtgcagcagggccatggtgacggcgcggccggtcagggcgcgcagcgggccggcgctctccggtgcggtgaagtcgccggccaggatcaggtcgtaggtttccggccgggcggtgccggtgagcagggcgggggcggcgaaggcgcggctctgcggggtgcgtggccggcgggccggttcccggccggcgacgatccgggtgtgccaggcctggcatgccgacaggtacgcctgccgggccgggtgcagccagccgggggcctgatcggcgctggacagcgagccgccggagagccggatcagggcgagggtctccccgccgaggtgctggacggcgggccggccgaagaccgcgcgggcccgttcgacgtattccgcgtccgcgcccttgcggacggtgtccaggtagccgagccgctccagggccggctcccgccggatcatcaacgacgagaggttgtacgtccgatggtgcggatgccccgggcgggtgatcaccaggtcgccggtgacgcgcatcccggcggacgtgacggccaccaggccacggtcggcgagcagcggcgccacctggcgttccaggcgtagcgggtgggaccagtcgtcggagtcctggaaggtgacgaactcgccggcagccgcgtccagggcggcgttgcgggccaggtaggtgccgccgttgacgggcatccgcagcacccggatccgcgggtcgagggcggccgcccggtccaggatcgcggtgtccggggagccgtcgtcgacgatcaggatctcctggtccggccagctctgcgcgatcagcgagcggatcgtgacgagcagcgccggctcgggccggtaggtggtgacgatggtgctgatcagggtcccgccggcggtggtcggggcgatcccgggccggatccggtcgaagcgcggcccggcgccctcggacagggcgatgccgggcgccgggagcaggccgttgaaccgcgtcagccaggtcgatggtgcggccaggtcgacggcgagcgcctcgcggatcggccggggcaccgcacggtagcgctccagcaggtcggccgcccgaccggccgggaacgcgagttgcacatgcagaccctggtgggcgggggcaatcgcggccggcccgtgggcccgcagcagggcgtcgaacagggccagcccgtcggcccggtcctccggctccagatcttgcagggcgatcacccgggccagttcgccgacgtcccacgggtcggcccggtccggcagggggcgtccggcgcgggcccggctgagcaactggtcgaggtcggtgacgccggcggcgtacgcgagcagcgcccgggcgtccgcggaccgggctcgcagcgcggccgtcgcgggcccgtccgggccggtcttgcgcaggctccgcagatgccggtcgagcagggcggatccgtacgcgcccggggtgatgtgcgtccgcatggaatgcccaacgccccggcccggcccggcgtgacgtgatcaccccgcgggtcgttgcacccggggggcaaaagccgagcagggggagtgcacgagcatgaccgcgaccgtccatgacgtggcgatcctctccgacttccggtatccgggcgggaactcggcggcgatcgcggccgaggtgcgcgcgcaggccgaggccgggttgcggaccgtcctggtgcacgtgccgtcgccgcacaaccgggacgggttgccgttcagcccgcggatcgccgagctgctccgcgacgggtcggccgagctggccacgccggacgcggtgacccaggccaagctgctggtgatccggcagccgcggatcttcaccgaggacctggcggtggtcccgcggatccgggccgggcgcaccgtgatggtgctcaaccaggcgcccggggatgccgccgatccggcgcggtactacgacttcgccgaggtgcgcgaccgggtcgagttgtacttcggtccggagatcgagtggatgccgatcagcccgcagatccggcagggcctgtccgatttgtcggaccaggactggcatgagatcatcgatgtgggcgagtggcccaacgatgtcccgcggaagcgggacatcccggtgatcggccggcacgggcgcgccgacctggtcaaatggccccccaccgcgggcgagctgctccaggcttaccccgacaagccggacatcagggtacgcgttctcggtggcggtgagatcgccacccgcatcctcggccgccgccccaccaactgggagatcatcccgttcggccaggaggagcctctcgccttcctgcgcagcatcgatttcttcgtctacttccaccaccccgatctggtggaagcgttcggccgcacgatcctggaggcgatggccgccggcgttcccgccatcatcggcgagcacttccgcccgatcttcggtgacgcggccctgtatgccaccccggccggcgtcgagcccctcgtccgccgcctgtgggccgacccggcgtcctaccgcgcggtcgcggccaaggcccgcgagttcgtcgacacccgctacggcgtcgcctcccacctggcccgcctcgccgaccgcggcgccggcgcccgccccgccgcccaccgggcttccggcacggcccggcacggcgagcccaccccccgcccccgcccggtcctgatgctcagcgacaacggcgcgggcctcggccacctgtcccgtctgatggcgatcggccggcgtctgcccgagcagcatccggcggtgatcgccacccagtcgtacggcgcctcggtcgcccaccgcgagggtttcctcaccgagtacctgccgtcccggaccgttctgggcctggccaagcagcgctgggccggtttcctgcaggcccgcctggaacacctggtcgacctgcaccgcccggccgtggtcgcggtcgacagcgtcccgcacgagggcatcgtggcggccgccgcggcccgcccggacgtcacctgggtgtgggtgcgccgaccgatgtggcggcgcggcaccggcgccgagtggatcgcccggggcgccgccttcgaccggatcctggagcccggcgagttcgccgcggcggtcgatcggggcccgaccgtggcggaccgggccggcgtgcacgcggtcgacccgatcatgctgctggaccgggcggacctggccgcgccggacgaggcccgggccgcgctgggcctggaaccgggccgtccggccgcgctgctgcagctgggcgccgggaacatcaacgacatcgcctcgccggtcggccggatcgcccggcagctgcgcgaggccgggttccaggtgctgctcgccgagtcgatgatcgcgaccgaaccgatgccgccggtgcccggggccacggtggtcaaggtgtacccgatcagccggtatctgcgcggattggacctggtggtcagtgcgtccggttacaactccttccatgagctgctcgctttcggcgtgccggcggtgttcgtgccgaaccgggagacgtccctggacgaccaggtggcccgggcccggttcgccgcctcctccggggcggcgctgtgggtggaggacccggacagcgacgagctggaccgggtgctggccgaggcggtccggcccgaggtgcgcgaacagctggtgcgccggtgcggggaggtgggcttcgacaacggagccggggccgcggcacgctggctggcggaactcgccgccgaaaccgtacgaagagccgagaacgtacgaagcggagcgtgaacatgtccgatctgtccaccaagccggagctggagagactgcactgggagatcgccgcgctgaccgggcggatgcggtcggtcgagttggagcgcgactcctggcgggcccgctgcgaccggctcgtcgagcagcgtgaccgggagcgcgagaagagccggaagctggccgacagcggctcgtaccggctgggccgggccctggtgtcgttcgcccgcgacccctggcacacctcaccgcggctggtccgcggactggcctagctagctagggtcgtgcccgggcaggccggccggccgccggtcgccccgcgccgtccggcccacctgtacgtggcgatcgggctggaccacgacgccctgcgggacttcctggtgacggtcaaccagcggctgctggtgacgccggaccaccggccggtggtgctcaccgacgatccggcgttcgccctgctgcgcaagctcggggtgctgatggagtacctgccggaccgggccacctgggagcggcaccggcccgaccgggcctgggacgacctgctcgccgagcggcttgcccagctctgccgggaccacaacaccgagcggaccgtggtggtggaccggctgcacccgccggccctggccgacctactgaacacgcggtagcgccgcgtccagcagcggcgccaccgtctgggcgaaggtcgtggtcaggtggttggagtcgcggtaggcgagcacgttgccgatcaccggcgggcagaagtcggtgcacagccacggatccgggtcgaccacggtgaccccggtcaggccgggcaacaccgagcgttgcgccggcccgcgcagggccgacgtggcgggcttgccgcaccggttgatccgcttcaggcgcgcctggcgggccacgcagaccgggacccgctcaccacccaggtacggggtgtcctcgatcagcgcgaccttcgccgcccccagtgcggcgaaggtccgctgccagccggcccgccactgcgccgcctcgtcggtgcgggtgtcgaccggccggtagttgaagctcgacccgatcaccacgagcgccggtctcaacgcccggatccgggcctcggccgaggtgtggaacgcggcgcactcggtgtactcacgtttcagcccgtcgtgccagagcggcaggtccgcggccgagcacgacgacttgctgatcgacaccagccgccagtggtgctgctcggccagccggtccatcgccgggaaccactgcgcggcgtgcgagtcgccgtagagcacgacggtggtcgtcgaccccgggtcgccgtattcgcagccggccggcgccaccaggaccggcgcctcgacgtggcagccgtccgcccacacgcgggccttgtcctggttgacccgggccagcgtgggggtcaggttggcgggcagctcgcgcaggccgcgggaggcccggaccgcccgggtgaccaccgcgtacgggtcggtggcatgcgccgtggcggcccgcaggtcacggatcgccgccccggccggcaccgggtgcggcagcagcgcgatggtgaccgcggtggcggcgaccagggcggacagggcggcgcccagcccgagcgccggggcggtccgcacgcgcagccacgggtggtgccgcaccgggttctccaccaggtggtaggtcacccaggccaggccgagcccggccgcggcgagcagcagcgacagcggcagtgacggatcccggccgagcgcggccggcccgatcagcagcagcggccagtgccacaggtaccagccgtaggagagccggccgaccgcctgcaggggccgggcctccagcaggggcaggccgccgatcagcacggcggtcgtgccggccaccgggagcagggcgtagaagccggggtacgcggtggcgtcgtcgcaccacagcgccgccccgaggatcgcggccagcccggcaccgcccagccacccgttgcggaccttcggcgcgaacagggccaccagcgccccggcgcccagttcccaggcccgggtgtgcgggccgaaataggcccacggcgccgaccgggtggtttcccacaccccggcggtgaacgaggcgagcaccagcccgatcagcaccggccggcgccgcggcagcatcagcagcagcggccagatcaggtagaactgctcctccacggccagcgaccagaagtgctggaacggcgacggcggtgcgtcggcgttgaggtagtccgtgccggtcagcgcgaaccgcagattggcgacgtacccggcggccgacagcgcgtccctggccaggtcgcccatccggatcggcggcagccacagccgggccgcgagcagcgtgctgaccagcaccagcgcggcggccggcagcaaccgcagggcacgccgggcgtagaagcggcggatcgacatccgcccggccgcccgctcccgcagcagcagcgaggtgatcaggaagccggagatcacgaagaagacgtccacgcccacgtagccgccggcggcgaacggcaccccggcgtggcccagcacgaccagcagcaccgcgaccgcgcgaaggccctcgacgtcggaccggaagttcggcgagaggctcatcgccctctaacgctccgccccggcgcggggtgtcgggtggtcgtccacgtcgcaacctcgttccggcggccctcgttgcgtttgctgtgactgcccagacgctgagtgcccccgccgatccggacaccggcccgcagcggcggtccgggcagccgacggtcgatccgcgcccgctgtggcgcggcgtgctgctgcgctcggcactggtcccgctgatcgtgctgtccccgctggtcgccgcgcaacccagtgccgaccaccggttcaacgtctacgccaacggggcacgctacctgacccgcccgtgggaactcgtcggcgcggcggtcacctcggtcccgcaatacctgaacctgggcaacttccgcccgctcggccggatcgccgaatggctgctggacaccctcaccttcgcgctcaccgacgtgttcggcctgcccgccaacatctcgctgcgcctagtctccttcctcagcgcgatcctgctcaccctggccgcggtggtgctgaccgagtgcgtgaccacccggggccgggcgttcgccggcccgccgtcgctgcccgtcgcggtgctgccgttcgcggccgccggcggtttcgtggccgccggccggaccagcaccacgatcctgttcggcgggctctacttcctcaccgcggcgctggtgctcctggtcgccgccgcggcggcgcacctcacgaacaacaccggactgggcgtacgcccgatcgtgctcgccctgacgctcggcctcaccctggcggccttcaacgagatggcctggctggccctgccactggccaccgtggtcgtcccgatccgcgcccggctgatcctgggccggtcctggcgggacaccctgaccggggccggcgcccggttcaccgggctgctctgggccgggttcctgccggtcgccgtcccggtccggctgatcatcgcggcccggtgcgcggccgggcgctgctactccggctccgatgtggcgctgcccggcgccccgggcgcgctgcccaaccggctcaccgcgtggatcccgccgctgatgtggcagcgggcgagcgagggaccgtacggtcacaccctcggcccggccctgctgctcgccctgctcgcgatgctcccgctggtgtggaagctgcggcgggagctgcccggccacccggccgccgaccgccggcaggtgctcgcgctggccgcgaccgcgctggccgtgctggtcccggccgccgccatgggcgccctcaacgagcagatgcagcacctcgccgcggccggctggtgggggctgggctggcgggacagcgcgctggccggggccggcggcgccctgctgaccgtggccccgatcgccaccctgcggcagcaccgggcccggctcgccgcagtgctgctgctggccgtcgtcgcggcggccggcgcctcggccaaccgcgactaccgggccggcaccgcgtcggagaagccggcgttcgtgcacgaccgggtggcccaggagatcgtcgacttcgaccgctcggcggccggcgacgcccgtcggtgcgagctgcgccggcagttccgggacagcctgccaccgggccgccggaccggatacccgcccgagctgcgccgcttcgaccaggccgtcgacgaggcgacccgcgagctggccgggcggcgcttctgcaccggggcgccggcatgacccccggccgcgtctccgtggtcgcgccggtctacaacgagggcgccggggtcgaccggttcgtcgaccggatgcgcgaggtgctcgccggccacgactacgaactggtgctcgtcgacgacggctcggccgacgactcgtggcgccggatcgccgggcacgccgcgcacgacccgcgggtgcgcgggctgcggctgtcccgcaacttcggcaaggaggccgcgctgctggccggcctggaacacgccgacggtgacgcggtcatcgtgatcgacgccgacctgcagcacccgccggccgccatcccggacatgatccgccgctggcgggccggcgcccaggtggtcgaggcggtcaaacgcaaccggaccggccagtcgctgagcagccggctgggcgcccgggtgttcaaccacgcgttcacccggatgaccaaggtcgacctggtgaacgccaccgacttccggctgctcgcccggccggcgctggacgcgctgctgcagatgcccgagcactcgtcgttcttccgcggcaccagcagctggatcggcttcacccgggaaaccgtggaggtggacatcgaccatcgggagggcggcgcgtcccggtggaccgcccgctccctgttccggctcgcggtcaacgggctcacctcgttcacctccgccccgctgcacctggtcaccctggtcgggctggccttcgcggcgttctccgcggtgctcggggtgcagaccctggtccgctggatgcaggggcactcggtggccggattccccacggtgatcctgctgctgctggtcaccgggacgttcgtgctgctcggcctgggggtgatcggcgaatacctggcccggatccacgaggaggtccggggccggccccgctacctgctccgggacctggccggtccgcgccggatggccgagcattccggcggccgcctcggcccgctcgatgtcccggtggccgagcgggccggcgggggactacggtcgctcgatgtcccggagcagtgggtggagcgtgcggagcggcggtgagccggtccgggcgctgctgcccggtccgcgcctggcccgcgtggtccgctacggactcagcggcggcgccagtgccctcacccacttcggcatcggtctgtgcggcgtccacctgctgcacctgcgcccggtggtcgcctccacgaccgggttcgtggccagcatcgcggtgtcctacgcgctgcagcgctggtgggtcttccgctcgacgacgggccacgcgatcgccggctcccggttcctgatcgtcaccgcggtcgccttcaccatcaacacgctggtgctgtggctcggcaccgaggtgctcgccgcgccctacccgatcgtccagccgatcgcgctgaccctgattccgctggtcaactacttcctcaactcccgctggaccttcgctcaccgttgagcccgggtggccgggcactcgactcccgctggaccttcgctcaccgttgagcccgggtggccgggcactcgactcccgctgggcggtcgctcaccgttgagcccgggtggccgggcactcgacttccgcggggcctcggcgagccgctgggcccgcggggccgggtttcgccgtccgggaccacccacggaccgtgaagaggccggcgatcgccctggacgcgcagcggccagatcgccggcctcggcccgcgcgggagcatgcgatctgcaccccgctggacctgcggatatcaagattttggtcttgatatggatcgcgaagtcagagtcgatgcgcttcccggcccgtggtgacgccccgggtgtcgaagaagcgcttcgccagccgcgccaggtggtccgcgtcgtactcgcggtggttctgcaccaggatcaccaggtcggccgaggccaccgcaccctccagatcctccgtccgggacaccggaacacccccgatgtcccaggtgcccacgtgcgggtcgtggtaggacaccgtcgcgcccagcgcggccagttggcgggccagcggcgccgccggcgactcccgctggtcggcgatgttcggcttgtaggtgatgccgagcagcagcacggtcgccccgcgcaccgcctgcccgtccgcgttcagcaggttctgcgcccgccgcgccacgtacgccggcatcgtcgcgttgatctcctgcgccagctccacgaaccggaacgggtatcccagcttgctgcgcacgttgtgggacaggtagttcgggtcgatcgggatgcagtgtccgcccacccccggacccgggtagaacgcctggaagccgaacggcttggtggacgccgcgttgatcacgtcccagaggtcgatgtccagctcgtggcagaaccgggccatctcgttgaccagcgcgatgttgacgtgccggtaggtgttctccagcagtttcgcggtctcggcctcccgggtgccgcgcgcccgcaccacggtttcgatgaaccggccgtagaagccggccgccgcctcggtgcacgcggtggtgtacccgccgaccaccttcggggtgttgtgcgcgccgtactcggcgttgcccgggtcgatccgctccggcgagaaggccaggtggaagtcgatccccgcggtcagcccggagagccgctccagcagcggccggaccacgtcgtcggtggtgcccgggtaggtggtcgactccagcacgaccagcatcccggcgcgcaggttgcggcccaccgagccggtcgcgccggtcaccgcccgcaggtccgggccgtcgccctcggagagcggggtgggcacgcagatcaccgcggtgcgcgcggtggcgatctcggtctcgtcggcggtcgcccggaacccgccggccagcatctcggccacgtcggcgtcgctcaggtcgtcgacgtgcgaccggccggcggccagcgacttgaccacggtctcgtcgacgtcgaagccgagcaccgacatgccggcccggatcgcctgctgggccaggggcagtccgacgtaccccaggccgaggatgacaacgtcgtagctcaaggaattctcctggtgagttgcggggacggggcgggtgccggccggcgggggccggtgggccggtgcgtgagttcgaacggggacgggaacggcaggtaggccggcaggaactcggccagcagcgcccgctgctcgggcaccgcggcctcgccgctgtccacgtcgttgaggcagagcgtgtcggcgtcccgggcgcgcagcagggcggccagccgcagcggggtgtgcgggtcggccaggtcggcgtaccggtgccggatctcgccggggatcgcccggccggtcaggaacgcgtagtactgctgcagcgaggagagcatcgacacgtcgtccgggtgccggaactggtgttccgcggtgccccggacctcctcggcgaagcgccgctcgatctcctggagcacgctgcgtcgcgccgggtgcggggtgtgcatcatcttgcgggtcagcacccgcccgaaggcctgctcgatcagccgccggttgttcttggccgcggcgtcggccggccggtcgccgggcccgcgcggggccaggtcgaccagggacggcgacggaaagaagcgggtcaggccggtcgcggtgaagaacaggtccggggtgaccggccggcccaggaacacgtcgtcgttgaggtagaggaagtgctcggccagccccgggatccggtgcagccgcgactcgatggcctgcgagttgaaggtcggcagggtgccggtgccgccgaagatctcccgatgcccgaccacggtcagccgcggatgcccgcggttcagccaggccggcgcctgcccgtcggtgaccaggtagacgtgccgcacccagggcgcgaagcagtgcagcgcgcgcatcgagtagcgcagctcgtcgcggctggcgtaccgggagtcgttggccgcctgcgcgtgcagcccggccacccacgggttgccggccagcgcctcggccttgcgccggcgccacgccgggtcgccgccgtccacccaggtgtagaccgcgtcgatcgggaagtcgatccggtccgggacggcggtggtgaagacccgtcgggtgcggtgcaggctgtggtcgtcggtcgcgcggaacgccccgaaggtcgcctcgggagcggtcaccaccggctcgccggccgggaaccggtccgcgaccggattgcgccgcggcgccgtcaggtggtcccggtcggttcgccagaactccacgtcacagccgaactcgggacccagcaccaggccgccggccgggtcggtgaccggccaacagacgctcaccacccgtcggtcccggcggatcatcccgcgatcaccgcccgcgagccgccccaggaggcggtccaccaggtcgcgatcggtttccggtacgccgagggcggtccgccgcgggtcggtgcccggcacccggaaccagtcgacgccggccgcgtccagggccgcggtcacccggtcgaggttggcccggcgcacctcggccgggctggtcgcggtgaccacccgggccccgcggacgacccggccggccagcggggccagggtccgggcgacccgcagccggcggtccggcgcgatccggggcagcaggcggttcccggcctgggcgatccgccgccggatcggccagggcgcccgccgcagcatcgcccgcagggtcacgtcgtcctctcgccgcaccacgcgtgcttcaacgccgcggcggagacggaagttgcggtctataccttttatgggtggatgtcggtaattacgcatgtcccacccctaggggaacgtctcaggggcacggcggatgcgcgaggttgcaccggcacggcatggtggtaggcagtcgatgaccgggaggctcgggatgggcaaagcagtgatgttcgtgctggcgctgatcggcggtgtggtcgtggtgagctgggtcttccacgcgctgttcggtgcgttcttctacctgctgctggtcgccgcggtggtcggcggcgggctctggctctacggcaaggtcaagcgcgagatcgccccggggacccgcacgcagcggcggatcgaggcggccacgaagacctaccggatgcgcaaccggtgagcgttccgcccgccaagtagtcttgcggacgacgccatcaccaccgaccaacgggaagtcgcaccgtgtttgacaccctgagtgaccgcctgtccgggatcttcaccaagcttcgcggtaagggcaagctcaccgacgccgacatcgacgccaccgcacgcgagatccgtctcgcgctgctcgaggccgacgtggcgcttccggtggtcaaggcgttcatcgccaacctcaaggagcgggcgcgcggcgccgaggtctcccaggcgctgaaccccgcccagcagatcatcaagatcgttcatgaagagctgatcaacacgctcggtggcgaggggcggcggctggtcttcgccaagcagccgcccaccgtgatcatgctggccggtctgcagggcgccggcaagaccacgctcgccggcaagctgtcccgctggctcaagaaccagggccatcagccgctgctggtcgccgccgacctgcagcggcccaacgcggtcaaccagctgcaggtggtcggcggccgggccggggtcgacgtctacgcgcccgagccgggcagtggcgtcggcgacccggtcaaggtggcgaaggactcgatcgaggtcgccaagcgcaccgccaaggacatcgtcatcgtcgacaccgccggacgtctcggcatcgacgaggagatgatgcagcaggcccgggacatccgcgccgcggtcaacccggacgaggtcatcttcgtcatcgacgcgatggtcggccaggacgcggtgcagaccgccgaggccttccgcgacggcgtcggcatcaccggcgtggtgctgtccaagctcgacggcgacgcccgcggcggcgccgcgctctccgttcggcacgtcaccggccagcccatcctgttcgcctccaccggcgagaaactggaagacttcgacctcttccatcccgaccggatggccagccggatcctcggcatgggcgacgtgctgaccctcatcgagcaggccgagcaggccttcgacgaggatcagaaggagaagatggccagcaagctgctcggtggcgagcagttcacgctggaggacttcctcgaccagctgatcgcggtccgccggatgggcccgatcgccaacatcctcggcatgatgcccggcatgggccagatgaaggaccagctggccgagctcgacgacagccacttcgatcgggtcaccgcgatcatccgctcgatgaccccgcaggagcgcaccgagcccaaggtgatcaacgcgtcccgccggctgcgcatcgccaacggctccggcgtcacggtgatggaggtcaaccagctgctcaaccgcttcgccgacgcgcagaagatgatgaagcagatgagcgggatgatgggcctgcccggcggtcgccggtcggccaccaagagctcgaagaacaagcgcaagggcaagaacaacaaccggccgcggacgggtggcgggctgcccggggggatgccggccggcttccccggcgggatgccgcagctgccgccggggctggacccgaacgccctggccggcggaggcatgccgcccggcttcaagctgccgaaactcgacttcaacaagctgaacaagccgaaagacgacgaacggtaactaggcatggcgcgtcttgtcgcggcgctagtatggttggaggcgatcccatcaaggaggagccggtgaccgctgcgccgcacttgagcgagttcgagatgatcgactatctgctcggccgagacgacctgaccgtcgacgacatcgcagaccttcccgaggatctccgatacgagttgatcgacggaaggctcgtcttgtcacccctcgccatgccgttccatcagtacctgagcttccaggtcgctaccgcggttcatgagttctgcccggacagcgtccttgtcaacgtggagcaggcggtcctgctggaccgcaggaacgagttgcgtcccgacatggttctggtgcgagaggagggcgcgctgaggtcaccggtcaggccggaggatgtgccgttggtcgtggaagtcatctcagagtcctcgaagaggttcgaccggaccgggaagctgaagaagtacgcctacgtcggaatcacgaattactggatcatcgatccattggccgatgacgtcagcttcacccagttcgcgctaggcgcggacggttcctatcggcagttgctggagaccagcgacctggtgacggtcgaccagccctggcaagtcacgctcgatctgccggcctggacgcggcgacgcgatcgcattcgtgcggtggcccggccggacatctgaggcgctgatccggtaggactgttccatggcgttgcatgtgcgtgggacggttttgccggacggtgaggtccgggacatctggctggtgggcgatcggatcaccttcgagccggtgggcggggccgagacgatcagcgacggcgggttcatcgtgccggggctggtcgacgcgcactgccatctggggatcgcctacggcgcgaaaccgatcgagagcctcgaccaggcgcgcgagctggcgcacaccgaccgggacgccggggtgctggcgctgcgcgacgcggggtcgccgttcccgtaccccgagttggacgacgagccgggcatcccgcgcctggcccgggccggccgccacgtggcgccgccgcgccgttatctgcgggacatcggcgtggaggtgcccgccgaggaggtcgccgccgcggtcaccgcccaggcgaaggccggcaccggctgggtgaagctggtcggcgactggatcgaccgctcggtcggcgatctcgccccgagctgggatgccgagaccatggccgccgcggtcgaggccgcccacgcggccggcgcccgggccgcggtgcacacgttctccgaggagggcgtcgagatcatggtgaaggccggggtggactcggtggagcacggcaccggcctgtcgctggaactgatcgacgagatggcccgccggggcaccgccctggtccccacgatgatcaacatccggaccttcgggaagatcgccgaccaggcccgggagaagttcgccggctacgccgaccacatgctcgccctgcgcgacaacttccccgaggtggtgctggccgcgcacgaggccggcgtgccgatctacgtgggcaccgacgcgggcggcgggatccggcacggcctggccgccgaggagatgctctacctgcacgaggccggcatcccggcggccgacgtgctggccgccgcctcctggaaggcccgcgcgtggctgggcttccccggcctggtcgagggcggcctggccgacctggtcgtctacgacgccgacccgcgcgccgacctgcgcgtggtccgggcgccccgccggatcgtgctgcgcggcgccgtcatccgctagcgggtgaaccgccagctgtacaggccctgcccggtcgggcaggtgagcagcccggtgtcccagtcgcaccgcccggagatctccggcatcgtcccgagcgtcaccttccggtagtcgatgttggagacgccccgggcggtgaaccggccgtcgccggcgtcccgggtcagggtcagcacgttcccgtcgtcgatgaacccgccgatcccgttgtcggagtaccgggcctgcccgttctcgtcgtacagcgcggtgcccttgtcgccgccgccactggtcatcacgtgcccgagccggaccgacgacgtgccgctcagcggcaccgctccagtacggcgcagcacggtgccgccgacggcgtcgatcaggagaagtcgtacgtcgctgccgtcggtctcgtacaggcagagccggtcgtggccgcacgggaagtaccggtccatcgcccaggagccctgccggtcgtagaggatgcgctgcggcgtgccgatgccgagtcccccgggggtcgactcctcggtgtagaccatgccctcgtaggcgatcagttcttgcgcgtcccgccgggcccgtgtctgggattgcaccttgccggtccggatgttccggatcaccacctgcccgcccgaggtgatcgacaccagccggtcgtcggtgaccgggaacgccttctccgactccggggagaacagcgccgccccgcccccggagacgtcctcggaggcgtccgccccggtcagcatcccgctgatcatcgtcgccccggccgcggcggtccacagccgccggccgccggccaggtcgtacgcgtcgatccgcccggtggttttggacagccgcaccaccacgtcgcggtgcaggaccagccggtcgccggtggtgtgcggcagctgccagcgtttcgccccggtggccgggtcgtggaactccaggacccggttgtcgggcgccttgatgtcctcgacggccggagccggttgacggaccaggatcaccgacttcgccgtggtggctacccccaggtaggtgctgtccagcccgggcagcgtccagagggtccgcccggtgccggcgtcgatcgcgatcgcccgggtcttcgacagcccgatcactcggtcgccggcgatccgcgccgccgtccaggtctccccggccggggccggcagcggctcgccgagtggcgccagcccgcggatccgggacggcgtggtggccggcagcaccgggtcggtgagccggtgctgccgcaccgccagcaccccggccccggccagcaccagcaccacggcggcggcaccggccagcaccgcccgctgccgggtgcgcagctgggcgccgcggcgtcgggcctgctcggcggtgccgatcgggaccgcgtcggcctgccgccccagcgtggtgaacagttcgtcgagatcagtggacacggttggctccttcctccaccgcgccgagggcggccgcgagcgcggcccggccccgggagagccaggatttgacggtgcccagcgcgacgccggtctcggtggcgatgtccgcgaccgaacggtccagcaggtagtgcagggcgagcgcgcgccgctgggcgtcgggcagctcgcgcatcgcccggaccagcagcaccaggtcctccgacggcggggccaccggtgcgggtggcggctcggcggcggcccgcgcgcggcggatgccgagccggcgccagcggtcggtggacagccggttcaccaccagtcgcagccacgcctccgggtcctcgtagccggacacccggcgccagcgctgccaggctcgggcgtacgcctcctggaccaggtcctgcgcctcacccggatccccggtcagcccgtacgcgtagcgcaacagccgccgggaggtgtcccggtagaagccgtcgaaatccatccgtcaccccgtccctatccgatgagggacacgggatgcccacccggccggttgcgcccggccacgactacgatgcttgctcatggctcgcgtgctcactccccgtgcggaggatttcccccgctggtatcaggacctcatcgccaaggcgcagctcgccgacaacggcccggtgcgcggcacgatggtgatccggccggtcggctacgcgatctgggagcgtatgcaggccgacatggacgcccggatcaaggagcagggcgtacagaacgcgtacttcccgctcttcatcccggagaactacctgcgccgcgaggccgaccacgtggagggcttctcgccggagctggccgtggtcacccacgccggcggcaaggagctcgccgagccgctggtggtccgccccaccagtgagacggtgatcggcgagttcatggccaagtgggtcgactcgtaccgtgacctgcccctgctgctgaaccagtgggccaacgtggtccgctgggagctgcgcccgcgcaccttcctgcgcaccaccgagttcctctggcaggaggggcacaccgcgcacgccaccgagcaggacgcccgggaccacgcccgcgagatccacaagcacgtctaccaggcgttcatggaggagctgctggccatcccggtggtgcccggccgcaagaccaagggtgagcggttcgccggcgcgaccaacacgatgaccgtcgaggccatgatgggcgacggcaaggcgctgcagatgggcacttcgcacgagctcgggcagaacttcgccaaggcgttcgacatcacctactcgtccgccgaccgcaccgtcgagcacgcctggaccacctcgtggggcacgtccacccggatggtcggcggcctgatcatggtgcacggcgacgacaacggcctgcggctgccgccgcggctggcgccgatccaggtgcagatcatggtggtcaaggccggcgagggcgtcaccgaggcggccacgcagctgcgcgacgacctcaaagcagcgggcgtacgcgtgaagctcgacgaccgggcggacatccccttcggtcgccgggcggtggacgccgaactgcagggcatcccgatccgggtcgaggtcggtccccgcgacctggccaacggcaacgccgtggtggcccggcggatcgacggcaccaagtcgccgatcgcgctggccgaggtggccgccgcggtggtcgccgcgctcaaggccgaccagcagcggctctacgacgacgcgctggccttccgggtggagcgcaccgtcgacgtgaagacgctgggcgaggcgatcgaggcggcgcagaccggctgggcccgggtgccgtggtcggcgatcggcgaggccggggagaaggaggcgaacggcaaggcggtcaccgtccgctgcctgacccgcgaggacggctcgatgcccgagtcggacaccgaggacggtctggtcgcctacctcggtcgctcgtactgatcgccaccggcgtgcgtttcaccgagggccggccggtcctctaccggaacttctccgccgaccggctggtcaacgtccgcccgtgccgggtggtctcggacgacgaccgcgggctgctgctctggctggcccgcggcaccccggtgatcatcgacgtccaccgggacggccgcgggacccgggacatgccgttcgccgagtgggcggtcgcgccgcgcaagcggatcgtgagcacctgggccggcccgggtgtcctgaagttcatcccgcccggcgccgaccactcggtctggttcttccgcaccgagcgggacaccttcaagaactggtacgtgaacctggaggcgcacgcgatccgctgggacgacggtgacgtcgccggggtcgacgtgatggaccaggatctcgacatccacgtcgacccggaccgcacctggcggtggaaggacgaggacgagttcgccgagcggctcgcccttccggagcactactgggtgcccgatccggaggcggtgtgggccgaggggcgccgggtgatcaagcagatcgaggcgggggagttcccgttcgacggcacctggaccgacttccggcccgatccgggatggcccgttccggcggagatcccgcccggctgggaccgtcccggggcacgatgacacccgattgggatcccggccatccgatctggcagaatggcttgttggtatccggcatgtcgtgaggcgccctctaacccctcaccgcacggccaatccacgaggcatcggccccgcatccccacgcgggttccggtcggctcacccacgcagtcaccaggagcgaatacaccgtggccgttaagatccggctcctgcggatgggcaagatccgcaacccgcagtaccgcatcgtcgtcgccgactcgcgcaccaagcgcgacggccgcgccatcgagtacatcggcatctaccagccgaaggaacacccctcgctgatcgaggtcaagtccgaccgcgtccagtactggctcggcgtcggcgcgcagccgagcgagcccgtgcagcggatcctggagaagaccggcgactggcagaagttcaagggcctgccggccccggcgccgctgctggtcgcgccgagcaagcagagcaagaccgaggtctacgaggccgaggccaaggctgctgccggtctcgccgacaccaagccggccgccacgccgaagaaggcgaagggcgaggccaagccggccgccgcgccggaggccgccgaggccaagccggagcagaccaaggtcgcggacccggccgagccgaaccgcgaggctgtcgccgagacggcagaggacccggccggtgccggcgccgacgcgagctgacggggcgctccggccggcgctggagcacctcgtcaagggcatcgtcgacaacccggacgacgtccgggtccgcctggtcgactcgcgccgcggcaagcggctcgaggtccgcgtgcaccccgaggacctgggaacggtcatcgggcgtggcgggcgcacggccaaggcgctgcgtcaggtgatcgggtcgatcggtgggcgcggcatccgcgtcgacatcgtcgacgcgtactgatcgatgctgctcgtcgtcggccagatcggtaaaccgcacggcatccggggcgaggtctcggtggtcgtgcggaccgatgagcccgaggcacgcttcaccgccgggcaggtgttcaccacggaggtcccccgggaccgccgggtgagcaccggcccggcggccgcgtccgcccccggcgctctcttcgaagttccgaaacagctcaccctcgagtcgatccgctggcatcagggccgcggcatcgcggtgttcgagggcatccacgaccgcaatctcgccgaggcgatgcgcggcgtgttcctgcaggtggacagcgctgagctggccccgccggaggacccggacgagttccacgaccaccagctgatcgggctgcgggtggagtcgctcgacggcaccgagctgggcaccgtgcagcggatcgagcatgctccgtcctcggacctgatcgtgctggccaagtccggcggcgggaccgcgttgatcccgttcgtcaccgtgatggtgccgaccgtggacatccccggcggccgcgtggtcgtcgatctcccggaaggtctgctcgatctgtgaaggtcgacatcatctcgatcttcccggactacttcgccccgctcgatctctcgctgatcggtagggcgcggaccaccgggacgctggatctcaccgtgcacgatctgcgcacctggacccatgacgtgcaccggacggtggacgacagcccgtacgggggcggtcccggcatggtgatgcgccccgagccgtggggtgaggcgctggacgcggtcggcagcccggaggcgaccctggtcgtgccgtccccggtgggccgaccgttcacccaggccgatgcgtacgagctggccgctcttccgcatctgatcttcgcctgcggacggtacgaggggatcgaccagcgggtcatcgacgacgcggccgatcggatgccggtgcgcgaggtgtcgctcggtgactatgtgctgttcggcggtgaggtcgcggtgatcgtgatcatggaggcgatcacccggttgctgcccggggtgctcggcaacgccgactcgctgaccgaggagtcgcacgcggccggcctgctcgaggcccccgtctacaccaagccggcgtcatggcggggccgggacgtgccggacgtgctgcgctccggtgaccatgggcggatcgcccgctggcggcgtaccgagagcttcgtgcgaaccgcgagccggcggccggacctgtacgcggcgtaccccccggagaacctggacaagaaggaccgcaaggcgctggccgaggccggattggagctcccgccacccggtgtggcaaagtagggaggttgccgtctcggctccgcgctgcgggaccgtgacgaggacccctcgaaagcgtggggggtcagatgtgcccatccgcgtcaccggcttccggggcgcacgagtaatacaaggatgcagcgatgaacacgctggacgaactcgacgcccagtcgcagcgcaccgacctcccggacttccgggccggtgacaccctcaaggtgtacgcccgggtcgtcgaaggcaaccgttcccgtgtccaggtcttccagggcgtcgtgatcggccgccagggcagtggcctgcgcgagaccttcaagatccgcaagatcagcttcggcgtcggcgtcgagcggacctacccgttcaacagcccggcgatcgacaagatcgaggtcgtcacccgcggtgacgtccgtcgcgccaagctctactacctgcgtgagctccgcggcaagaaggcgaagatcaaggagctgcgggagaagcagtccgtctgacccctctgctccggcaggcccgggctgctccggcaggcccgggcgcaagcgcattaagcttgcccgtgtgccggatgatgaaccattccagtcctaccgcccgtaattccctctagccgggaaactcgggcggtagtgctgtatccgggggcggttcggccgggattcgtcaggagatgcgaagcgtggatccgatggaagggtatcgaccgtcccggcggcggtcgctcatcaggcgcaaggaaatgcccctctggcaggagttgccgctgctgctcgtggtggcgttctgcctggccgtgctcatccgcaccttcctggtccaggccttctacatcccctccgggtcgatgcagacgacgctggagctcaaggaccgggtcctggtcaacaaggtcgtctacgacatgcgggacccgctgcgcggcgagatcgtggtcttccgcggcaccgacaactgggcgcccgaggtgaccgagccggtcagcaacacgttcggggcgaaactcgggcgtacgatcggtgacctggtcggggtgagccgccccggtgagcgtgacttcatcaaacgggtgatcggccttccgggtgacaaggtcgcctgttgtgacgaccagggccggatcacggtgaacgggatcggcatcgatgaggcttacatcgcgccgggccacaactccgacctgaaccagccgccgatcgccgggcagtgcaccagccgcaagttcgccgagatcaccgtgccgcccggtcagatgttcgtgatgggcgaccaccgcaaggtgtcccaggacgcccgctgccagggtccggtcccgattaagaacgtgatcggtcgcgccttcgtgaccgtctggcccaccagtagatttacgacgctcgaagtcccggacgtctggaaacagttcgcgcaacagcatccgacggccgccgccgggccacccggaccgcgcccgcggcaggatccccgggtggccggcagcctgtttccgctgctgatcaccgccgtgtggtccgcgcgttccagcatgtcgttccggactcgacgacgtaggctccgagcgtgattgacgagcagaccgaaaagcgccgcgggtcgttctggcgcgagcttcccattctgctgggcgtggcgattctggtcgccgtcctggtgcgcgccttcgtcctgcagacgttctacatcccgtccccgtccatggagcacacgctcaacgtgtgggaccgggtgctcgtcaacaagctcgtctacgacttccgtgacccgaaacgcggcgagatcatcgttttcaaggcgcccaccgagtggcagtccggcaacgagggcgaggacttcatcaagcgggtcatcggcaccccgggcgaccgggtggtctgctgcgacacccagggccggctgaccatcaacgggcactcgctggacgagccgtacatctacaccgacgcggacggcaaccggaaccaggtggccgacgagaagttcgacatcaccgtgccggccggtcggctctgggtgatgggcgaccaccgggaggcctccggcgactcgctggagcactatgagcagagcacggccaccgacacggccggcaagatggccgattcgacgatcaccatcgactcggtggttgggcgggcgttcacgatcttctggccggccggccgggcgacctggctgaccgtgcccgacacgtacgacgcgatcccggacgccgccggtcactgatcctcgggctccgctccgggccgcggcgcggtggccggccgctcatcgatcacgggccggttcgaaagatcgtctgggggcgcatacgcttgaccggtgaccgactcgaaccagcccgccgtcgtggcgcgccgtgccggccgggtgctcctggtcgatcgggccgggcgcgccctgctgctgcgcggcggtgatccggcccggcccgggctgcactggtggttcaccccgggcggcggcctgcaggacgcggagagcaccgtcgaggcggcggcccgcgagctggccgaggagaccgggctgcgggtgtcgcccggcgaactgggcgggccgatccggcacgagcacgccgagttctcctacaacgggcgcgactaccggcaggaacaggacttctttctgctccgggtggcggtctggcaggtcgacacggcggggatggacgccgaggagcggctgaccatcaccgagcaccggtggtggtcggcggccgagatcgaggccagcgcggagctgatctatccggccgatctggcggagttgctccggtcccaggtcgacgggcccgccgcggcttctgagggcaccgcgggcgtcgcggcttccgggggcgtcgcggcttccgggggcaccgcgggcgtcgcggcttccgggggtgctgcgggtgcggcggctgcttcgggagcgccggtgcatgcggctgacggcgtaccggaaatgggcttttgatgttggctcccgcccgcaccgtggtgcgccgagaggccgggctctacgcgttggagcaggcgttgcagcggcgcggtttcgcgcatgtcgccggcgccgacgaggccgggcgcggcgcgtgcgccggtccgctggtcgcggcggccgccgtgctgccggccggcaagcgcggagaggtgcccgggctggccgattccaagctgctcaccgcggcggcccgggaacgtgtctacgacgaggtggtcaaacgcgcgctggcctggtccgtgatgatcatcccgccgaccgaggtggacgcccgcggcctgcacgtctgcaacctggcggcgatgcgccgggcgctggcctcgctgaccgtccgcccggagtacgtgctgaccgacgggttcccggtcgacgggctcggcgtgccgggcctcgcggtgtggaagggcgaccgggtggcggcctgcgtcgcggcggccagcgtgctggccaaggtcacccgggaccggatgatggtggagctggacgggaaattcccggaatacggcttcgccgtgcacaagggttatataacggacgagcacagtgccgcgctgctgcggcacgggccctgcgccgagcaccgcttctcgtatgtgaacgtcgccgccgcctccgggcgcggcaacgtgccgccgcgagcgcgccgcccggcagcccggccggcggaccccgcgccgtcgctgttcgatgtttccgttaccgagccgctgctgcttccgcgcgcggctgagggtaccgtcggcgtggcgtcgggcgagcagcctcagccgtcgccgtcggtgggggaagatgaggccatggagggcgagacacgatgagcgcagaggatctcgagaagtacgagaccgagatggagctgcagctctaccgggagtaccgcgacatcgtccgccagttctcctacgtcgtggagaccgagcgccggttctacctggccaaccaggtggacctgcacgtgcgcaactccgacggcgaggtgtatttcgaggtcgagatgcacgacgcctgggtctgggacatgtatcgcccggcccggttcgtcaagaacgtgcgggtgatgacgttcaaggacgtcaacgtcgaggagctggagaaaccggacatctcactgccggacgacgccggcttcggcggctgacgggttatccacagcggggcgttgtccacagggcgggtcgccggccggcgtgcggccggccagactcgccctcatgtctttcctgctcgccctcctgctggccgtcggactgctcggacttccgcacgagtcgccgccgggtctgagattcggctggccactcctgccggcccgggtgacgcggcccttcctggcgcccccggagccgtggctccccgggcatcgcggggccgacctggccgggcagcccggcgatccggtgcgggcggccgcggccggcacggtcgtctacgccgcggtgctggccgggcgcggcgtggtcagtgtggcgcacgccggcgggctgcgcagcacctacgagccggtcgacccggcggtcacggccggctcgacggtcaccggcggccaattgctgggccggctcgaccccgggcatccgggatgtccggtcgcggcgtgcctgcactggggcgtacgccgcaatgatctttatcttgatccgttgatcctgctgggtatcgggcgggtgcggttgctaccactgccagtggtgcagcaggctgggtaggcgatcggccagatggtgatactcctccggccggttgtagatctgcgcgctcagccgcagcagcccccggccgccccacgcgttgatctgcgtctccaccccgagcttgtcggcgatgtgcccgcgcaacgcgtgcgcctcgggaaaggtggtggccaccccggccggcagcggcacgatccgcatcgagaccccgggtccgcccggctccggcagatccgccggcgcatgaccgagggccgcaccgaccacccgctggccgtacgccgcgagcgccgcattgtgctcccggacgacttccgggcccagcgtgcgcatcgcgaagatcccggccggcgccgccagccacggggtgtagtcgatcgtcccctggaactcgaccgacagcgggaaaccctgatcctgctcccaggagacgaccagcggatcgatccgccgccgccagtccggcgacaccgccagcagcgacgtgccgcgcggcgcccaaccccacttgtgcagattccccacccagaaatcggcgccgatctcctccacccgcaccggcagcatgcccggcacgtgcgcgccgtcgaccatcaccgggatgccctgcgcccgggccgcggcgacgacctcccgcaccggcatcagcgtggccgtcgccgaggtcacctggtcgatgatcagcagccgggtgcgtcccggccgcagcgccgcccgcacccgggacaggacctccggcccgctcgcgccgaacggcaccgcgatcgtccgggtcgtcgccccggtccgccggcactcccggcgcaccgccatcgtcaccgcaccgtaggcgtggtcggtgagcagcacctcgtccgattccttcaaccggaccgactgcagcaccaggctgaccgcggtggtggtgttcgaggtgagcgcgctgccctccgggtcggcgccgaggaaagcggccagatgccgtcgggtgtggatgatccggtccagcaggcccgggccgaagaatcgcatcgggttcagatccatctcgtcccgcaggcgctgctgggcgcgctgcacggtgatcggcaacgcgccgaacgacccgtggttgagataggacaccgccggatccagcgagaacagcaaccgcgccccggcaatgggctgcggtggatcttcggcgctcatgcctgcgatcgtacggcttggttacatccgcctcctcaggacagtggcctgcggtcgtccctcgcgtgggtctggttttcgtcggcctggctcgcgtgcgtgctgccgacggtgggttgccggtctcaggcgcgggggtgtgcctggttgaacgcggcgcgcagacgttcggtggagacgtgggtgtagatctgcgtgctcgccagcgaactgtgcccgagcagttcctgcacggcccgtagatcggcgccaccgtccaacaggtgggtggcggcggaatgacgcagatcgtgtggcttggtgtgcggcagtccggcacgccgcgccgccccggcgacgatccgccggacgacggtgggctgcagacggccacccttcaagccgaggaacagcgcgtcggcggcgagcgacctcccggcacggcggccggttcgggcggggttccgggcgggaccgcgtaccgcaagccgatgatcacctgcaccggcggcggcctggccgtcgcccaccgccgcaagcaccggccggcctagacgcaaccacgcggcgagggcgtcgcgagcgggatgaccgtaggggaccgcccgctccttgccgcccttgccgaagacccggacgacctggcggttgtgatcgatgtcggtctgatcgaggtcgcagagttcgctcacccggatcccggtggcatagagcagctccagcaccgcccgatcccggatcgcgacgacatcgccacccgctctgtccgcctccgtctcgcctctgtccgcctccgtctcgcccgcctcctgcccgctcccgtccggcccggtggcgtccgccgcgctcgcacctgccgtattcggttctcggccggtgccggaaccgggtgggagactgggcgcggtgacgagggccacggcctggtcggcgcggagcacgtgcggcaggtcgcggtgggtgcgaggactggccaggcccgagccggcgtcggccggcgccagcccgatgcgatgcgcccagccggtgaaggtgcggaccgcagcggcccggcgcgcctgtgaagtacgcgccgcgccctcgtccaaccgcgccgccagccagccgcgcagcaccgcgatgcccaggtcgccgaccgccgaacacccctgctcggccgcgtgggcgagcaacgagacgacatccccgagataggcccgcaccgtgtgcgccgaccggtcctcgacgaccgccagatgatgcccgaaccgatccaccgcctcccgcagcgccggcggcaacgcttcgtgcatctcggtcacccgtttggcccgaggccgtcgtcgataggcgtccacggcgtccagtgtgccgtgttttcttgtcataccccgcccttagcttcagtccatggcgcttccaagggcgacgacgaacggggcggtggtgcggtgcgcggcatcgtcggcggtcgagatgagcgggttcgcgctggtggtcggctgcggggcgcgttcgagggcggcggcgagcggaccggggtgggcggttcggttcgtggtgggcaggggtgagggggatggatcaggaccgggtcagttggacgcggtcggcgggatgcactgtctcggtgccgtccgcgcttgtcacgaccaggaccgggacgccttcgcccaagcggtgtttgcgtcgctcggcgtcggtcggcatccgcgccccggcgcgctcgccccgggccagcgtgaccagttggaccggctcgggcacccggacgaacgtcccccgcggccgatccaccgtgacgagcccctcggtccgcagctgcccgatcgcctggcgcaccgtcgtccggctgatcccgtaatcctgagcaaggcgcagctcactgggcagcggctccccggggcccagctccccggacgtgatccgatcccgcagcaggtcagcaagctgccgaaacaccgcacggtccgccgaatgatcgatcatggcaattattttacgtgaccacgatgctccatcccgttgtacctacagaacaatataactatgatggtgatgtcgcaccggaaaggccagtccgaaccggtcggcagagcgggcggcggttttgccaggccggcctcacggggctgctgggcgcgaccccgcccgctcgcccatcgaccctgccgcctcaaattcggtcccgatccgcgacccagctccagctccagctccagctccagctccagctccagctccagctccagctgccgagctgcccctgcccctgcccctgcccctgcccctgcccctgcccctgcccctgccgggctatgggctgcagcggactaccggcgtcagtaggcggtcagcgggctgcggtctagcaggtgacagtgggctgcggcgctgtgggcgggctgcggctgccggtgggctgtgggcgggcaatgggctgcggcgttgcgggtggccagtggtcgacagtgggctgcggcgctatgggcggacggggagcagtgggcggccggtgcgttgtgggtggcgctgcgggcaactgctctttgtttccagaaccgggcctgcgggcgcgctggggcagggtattcctggcgggcgcccgggaccctggccggcagtgaccaggagccccgggcggtctggcgtcacggtgcgggcgggtctgtccatgcccagccgaggaagcgctggtacaggttcagcggcggcgcgccgtcgatgatcatgtcttccagcgcgtcgtacatctgggcggacaggtatatccgtagcagtgacggaaacgcgcggtattcgtgcagcagcgttccccgggcggtcgagcagggccatggccgcccgcaggcccggcagttccattcaggccgttcgctcacatggtcgatgtcctgcgcggtcgtcaacagcgtcccccgatttctgcccgacctgctatgcggcacgcagcgcgcctggtggcagtgcctctcatctccgatgttcgggttcagaagtgaatgctcagcggccacctcgccggcgatgcatgtggttcttgaacgggtcgttgcacaccgtgcggtaccgctgcccgggcgtcaggtttccggcgcggcccacgttcgcctccgggtgccgtgggcgcggttgtggcaccgccgcgcgtccgaccgcgaccgacggctgcccctcgtcaatgtcggtttgtcggtcgtcggtgcggacttgctggtcggcggcgtgcacccggtcgtccggatggcgttgccagacctcgggagcgacgacgtcgggaaaacgcgcacgaacggcgtcgctgtggaagcaggcgcggcgacgagtggggccttcggccaggtgatggccgccggagccgcctgtcaggtggtgcgagccggaaccgtcggccaggtgatgtccgccggagccgtctgtcggatggtgcccgccggggccgccggatgcggtgggagtagccgggtggtcgggacggcgggggatggatgggctgctccggcttgcgtggccgtccgcgggagcgggatggccggtcagcgggctgctccggctcgcgtgatcatctgccggagcagggtggtgggtcaccgggcggcgaagctcgtcgcagggccgacgctgccggggcgccgccgcaaggtggggcttttgtcggtcgggtgggacattgtcgaattttgcaggctcggggcggctcggggtggaggtccgtaacgggaagggtgggaccgggggcggcaccaggcgatcgatgcacggtgcgggtaggccgcagcggcaccgacgccacatggtgcgccagtcacggcgatgacgtggggaaacgggaacctgtccacttgtcgtgcgacgtctagtcatggcgacgatcgtactggcttgacgactacctgtctccggacaagatgctgaacgcctaattgtcccgcgcctacggtcgatcatgtgggagtgaagccgatccgcctcatgggcgcacacgagattcgcatccgcctgggtggcgtgagccgtcagcgggcgtaccagatcaccagccgtgcggactttccgaaggcggtcgcggatctggctcagggcaaagtctggctgaccgaggatgtcgaggcgtggatgaaggttcatcgccgtgacctggatgaatccgaagactgatcgtctccgcgccgtccggatcgaggcggtcgccggggcgcccgccgatccggatcggcggacaccggctgcctcgccggaccgccgacctgcccggatcttttgcgggtaagtggtggtgggaggcgggatcggagccgccgaagtccaccgtggacggcggtgcccgcgcggaggaaaccggcataacgtccgccggaaccggtgtgcattccgtcgatcgagtgggtgagtccacgtgactacccgcccctcgtcgccagcgtgatgcccgcctcggtccggaccaccaggccggcggcttcgagcagggacaggcgtcgcagcacggtgcgtacatccagccgggcctccgccgagatctcctccggggtcgccgcccggcggcgtggcagcgcctccaggatgagcgccgactcctcgtccagccggtcccggacgcgttcccggccgcgtggcgcgggctccaggaactcgccgatccggccgacctcttccagcacatcggcggcgcaggtgaccaaccgtgcctgcgggttgccgcgcaacagttcgtggcagccgaccgacatggtcgaggtcaccgggccgggaacgaccatcgccggccggtccagcgcgatcacccggctcatcgtctgtgtcgcgccgctgcgggccgcggcctcgaccaccacggtcccggcggtggccgcggcgatgacccggttccggatcaggaaccggtgacgcagcggatcggaacccggcggccactcactgaccagcagcccgtgcgcggcgatccgggtgaacgtcgtcgtgttggacagcgggtagggccgatccaccccgcaggccagcaccgccacggtgacgcccccggcggcgagcgtgccctgatgggcggccaggtcgatgccgaccgcaccgccggacaccacggtccacccctgttcggcgagaccgtacgccaggtcggcggccacatggacgccgtaacccgtcgaagcccgcgccccgacgacggcgaccgagcgttccagcgtcgcgccgagcggtggcgccccgcgcacccagaagcagagcggcggccgggtgtcccgattgatccggccccgagactccatctccagcgtcgccagcgcgtcgacccgggccggccactccggatcggccggcacgaccagccgcgcaccgatccgcgcggccgcttcgacattctcctccgcgatctgccgggcgtcaccggccccgcaccgcgcggcaaccgccgaccgcagcgacgtgtcgggaatgtccccagccagcagccgctccagcacgaccggcgccccggcctgctgaaccatctcccagaccacccggttccccggctccgccagccaggtcagcgccgcccgcgccacccggtccgactcactccccggcccgctcatgccgactgctcccggattgcgaggttctccccggtccgcagttgcaaggcctcggacacgtcatcggttgacggccgaccgcgcccgtcgagatcggcaactgtccaggccaaacgaaggactcgatcaaagccgcgcgccgaaactgtgccgcggtcaagcgcctttctcaacacggcggtgtcccgtgccggcaacagccatggctgtcgccggagggccggtcctggtacttcggcgttcactgtccagccgtcgcccgcccaccgttctgccgccgcattccgggcgcgaaggactcgttccgcgatggtctccgacgactcgaccggggattcctgggtgaccaactgcgctgcccgcatcggtaggaggtcaactttgatgtccacccggtccagcagtggtccggaaagtcgccctagatagcgacgccggatctgtgggctacaggtacagcgctggtcggtggtggcgcacgggcaggggttggcggcgaggaccagctggacctgggccgggtattcggtggtgccgcgggcccgggccaggatcacccggccgctctccagcggctggcgcagcgcctgcagggtggcccgggctatctccggggcctcgtcgaggaagagcacgccgcggtgggccagggacagcgcgccggggcgggccaggccgctgccgccgccgatcagggacgccatgctggagctgtggtgcggggactggtagggcgggcggcggatcaggccgctgtccggggggagcacgccggcgatcgactgcagggcggtgacctccagggcggcctcgtcgccgagggcgggcagcagggacggcaggcgttcggcgagcatcgtcttgccggcgccgggtgggccgaacagggccaggtggtggccaccggcggcggcgatctccagggcgtagcggccgagctgctggcccgcgacatcggccaggtcggggccggtgcgggccgggggcggggactccgggggtggttcgagcaggcggccggtgccgcggacgaagtcgaccaggcggcgcagcgagtcgacggcgcggacggtgacgccgggcaccacggtggcctcgcgggcgttgccgagcggcacgatcaccttggtgatgccggcctgggcggcggccgcgaccatcggcagcacgccccggaccgggcggaccgcgccgtcgaggccgagttcgccgagcagcaccacccggtccagcgggccgggtggcagctcgccggcaccggccagcagggcggcggcgatggccagatcgaagccgctgccgtgtttgggcagggcggccggcagcaggttgacggtgatccggcggttgggccactcgcagccgctgttcaccacggcggcgcgaacccggtcgcgggcctcgtgcagcgcggtgtcgggcaggccggtcaggacgacggcgggcaggccgagggagaggtcggcctcgacctcgacgaggcggccggcgacgccgatcaggccgacgcagagcacccgggcgtagctcatcagaacgccgccctcaggtgggtgacgcgggtggcgccgcgccgctgcgggcacacctccaccacgtcgaagcggatctgccgggcgtgctcgccggactcggccagccagcgcccggcgagctggcgcagtttgcgtaccttgcgcgggtggaccgcggcggcgggtggcccgaaggtggcggtgcggcgggtcttcacctcgcagaacaccagggtgtcgccgtcccgcaggatcaggtcgacctcgccgtcggcgcaccgccagttgcggaagagcacctccagcccgtgtttctgcagataccgggcggcgagccgttcgccgtacgccccgatcgcctgtcgctgagtcgtcatgccgcggacggtgacagagttcgcggtaccgtcgcggacggcctgtggacggcggggaagtgtggattacggcacgctcaccgccgcggtgtgataagcaccgccgtccgcggcccggctggcggtggcctgagaaaaatcggcttggcgtatgctggtccccggcgaccgcccacgcggtcgacctcgcgcgccctccggcggttccgagcgctgttcctagcgccggccggcggcggcggccctccctggtcccgatgatcttcgggtcaccactgcggccaccgaccgggcgccaggacacccaccgccggtgggtgtgacaaccagggaagatcagggagcaccaccatggccgtagtgaccatgcgtcagctgctggagagcggtgtccacttcgggcaccagacccggcgctggaacccgaagatgaagcgcttcatcttcaccgagcgcaacggtatctacatcatcgacctgcgccagaccctcgactacatcgagaaggcctacgcgtacgtgcgggacaccgtcgcggagggtggccacatcctcttcgtcggcaccaagaagcaggcgcaggaggccatcgccgagcaggcgacgcgggtcggccagccgtacgtgaaccaccgttggctcggcggcatgctgaccaacttccagaccgtgtacaagcgccttcagcggatgaaggagctcgaggccctgggtgacctgagcggcaccgccgccggctacaccaagaaggagaccctccagctctcccgcgagaaggagaagctcaccaagaccctcggtggtctgcgtgacatgaccaaggtgccgtcggcgatctgggtcgtggacaccaagaaggagcacatcgcggtcgacgaggcccggaagctcaacatcccggtcatcgcggtgctggacaccaactgtgacccggacgaggtcgacttcccgatcccgggcaacgacgacgcgatccgctcggccgagctgctgaccaaggtcatcgccgcggcggtcgccgacggtctgatcgcccggtccggccgccaccgcggtgacgccgacaccaagccggaggccggcaccgtcgcggccggcgagccgctgccggagtgggagcgggacctgtacgagggtggcgacaagaaggccgccgaggccgccaccgagccggccgctgctgagccggccgccgccgagccggccgctgccgagccggttgtcgccgccgtccccgccgagtaagtcaaccgacacgcttccggccgccgccgttcgcgcggcggcggccgatttcccgactgacatcgagagaagagtcatggctaactacaccgccgcggacgtgaagaagctccgcgaactcaccggtgccggcatgatggactgcaagaaggcgctcgaggagtccgagggcgacttcgacaaggccgtcgagttcctgcgcatcaagggcgcgaaggacgtcggcaagcgggccagccgcaccgcggcgaacggcatcgtcagccacgcgggcaaggctctgctcgagctgaactgcgagaccgacttcgtcgccaagaccccggacttcgtcgcgctgggtcagcgtctggtcgagttcggcgagcagaacaaggtggcggacgccgccgcgctgctggccgccacgatcgaggacggcaagaccgtcgccgatctgattcaggactacgccgcgaagatcggtgagaagatcgtcctgaaccgcttcgtgatcctcgacggcaccgtcgcggtctacctgcaccgcaaggcgcaggacctgccgccgcaggtcggcgtcctcgtgcagtacaccggcaaggacgacgaggcggccgattcggacgcccgcggcatcggcatgcagatcaccgcgatgcggccgaagtacctgacccgcgaggaggtcccggccgaggtcgtcgagtcggagcgccggatcgccgagcagaccgctcgcgaggagggcaagccggagcaggcgatctccaagatcgtcgacggccgggtgaactccttcttcaaggacttcgtcctgctggagcaggcttcggtcgtcgacaacaagaagacggtcaagcagatcgccaccgaggccggtatcgagctcacccggttcgtccggtacgaggtcggccaggagtaaggctccgtaacgtcatggcacgggaggtcgggtacgcgattgagcgtccggcctcccggtcgcataaggtctcctgcagaaagtgaagggaaggcgggtctcatgacgatggtgaccgagcagtccgccacggtcgacgagaacccgccggccatgcggccgcgccgggtcgttttgaagctgtccggtgaggtgttcggcggcggcgcggtcggcgtcgaccccgacgtcgtgcaggcgctggccaagcagatcgccacggtgaaccggcgcggcatccaggtggccgtggtggtcggcggtggcaatttcttccgcggcgccgagctgcagaagcgcggcatggaccgcaaccgcgccgactacatgggcatgctgggcacggtgatgaactgcctggccctccaggacttcctggagaaggagggcatcgagacccgggtccagacggccatccacatggcccaggtcgccgagccgtacatcccgctgcgcgccatccggcacctggagaagggccgtgtcgtgatcttcggcgccggcgccggcatgccgtacttctccaccgacacggtgaccgcccagcgcgcgctggagatccacgccgacatggtgctgatgagcaagaacggcgtcgacggggtgtacaccgccgatccccggatcgatccggacgcccgcaagctggagaacatcaccttccaggagatcctgcagcgcgggctgcgggtggccgaccaggccgcgttcagcctgtgcgaggagaacaaacttccgatgctggtcttcggcgccgacggcgacgacaccatcgtgcgcgcgtgcgccggcgagaagatcggcacgctgatcaccgcctgaggcgcgcgaagcaccctgtgaaccagcggccgaccccgacatcccgcaccaccgaagacagcaaggaggcgtgaagagccggtgatcgaggaaatcctcttcgaggcagaagagaagatggacagcgcggtcgagcacgccaaggaggagttcgccgccatccggaccggccgggccaccccggcgatgttctcgaagatcctggtggactactacggcgcgcccacgccggtgacccagatggcctcggtcggcgtcccggagccgcggatggtcatcgtcaagccgtacgacaacacgcagctcggcccgatcgagcgcgccatccgtgactcggacctcggggtcaaccccaacaacgagggcacccagctgcgcatccacctgccgcagatgaccgaggagcgccgccgcgacatgatcaaggtggcccgcggcaaggccgaggagggccgggtggcgatccgcaacgtgcgccgcaaggccaaggagcagatcgacaagctggtcaaggacggcgagaccggcgaggatgagggccgtcgcgccgagaaggagctcgacgacaccacgcaccggtacgtctcggtcgtcgacgaactggtcaaacacaaggaagccgagctgctcgaagtctgatgtcctacctcgatccgcgtgccgggcagaattccggcgacacctacgccgagccggcgtaccagaatcccgcctggcacgcggacgagcgggcgcccgacccgatgaaccacgcggacgagaaggcgcccgacccgatgaacagtgacgacgagtcccggcgcgggcccggcaagcgccgggccggccgggggcgcaagccggagggcaagagccgcgccggtcgcaatctgccggccgcgatcgcggtcggcctgagcctgggcctggtcgtcctggcctcgttgctggtctggtcgccggccctgctcggcgtggtggtcctggccgccggcgtcggggtctgggagaccagccgcgccctgtcggtgaccggtgcccggccgccggtgatcccgctgatcgccggcaccgccgtgatgaccggcctggcgtggtacgagggcgccgacgcgctcaccgtgggactggtcgtcacgatcggcgccgcggtgctgtggcgcctggccgacggtgtcgcggctgtccggcgggacttcacctcgatcgtcctgatcgccgtctacgtgccgttcctgctgagcttcgcggcgatgctggtccgcccggaggacgacggccagtggcgggtgctggccaccgtggtcgccgtggtgctctccgacacgggtggttacgccgccggcgtcttcctcggcaagcacccgatggccccgaagatcagcccgaagaagtcctgggagggcttcgccggttcgatcaccgcgtcggcgatcggcagcggcgccctgctgttcttcctgatgcacgtcccggtgtactacggcctgctgttcggcgcggtgctgtcggtggtggcggtgctgggcgacctggccgagtcgatgctcaagcgtgacctcggcattaaggacatgagcaacctgctgcccggccatggcggactgatggaccggctggactccatcctcttcgcggtgcccacggcctacctgctcttcgcgatcatcgcgccgaactagccatgggcgacctacccgtgacgcgtgggagactggagacgccatgacgattcttccggtcatcccgatcagccccgaccagcctgacgcggtcaccacccgccgccgccccagcatgccgccgcgccatctcgccgacctcgacctcgccgcccgcaagagcgcgatggccgacctcggcgagccggccttccgggccaagcagctctccacccactacttcggccgcctggtgcgtgacgccgccgcgatgaccgacctgccgtcggccacccgggacaagctcaccgccagcctgctgcccacgctgctgcacccggtccgcgagcaggcctgcgacgacggcgccacccgcaagacgctgtggcgcctgcacgacggttcgctggtggagagcgtgctgatgggttatcccgaccgggtcaccgcctgcgtgtcgagccaggccggctgtggcatggcctgcccgttctgcgccaccggccagcagggtctgacccgcaacctgtcggtggccgagatcgtcgaccaggtggtctatcttgccggggtggccgcctcgggcgcggtgaccggctcgccgccccggctgtcccgggttgttttcatggggatgggtgagccgttggccaactatccccgggtgatcgaggcggtccgccgcctgacggcccccgctccggaggggctcgggctctcacaacggcacatcaccgtgtcgacggtgggtttggtgcccgcaatgcgccggttgatcgccgaacagctctccgtgactcttgcgctgtcactgcatgcccccgatgatgatctgcgcgatgagcttgtgcccgtcaaccagcgttggaaggtggccgaggtgctcgatgccgcgtttgattacgcggcgcagaccggtcgccgggtctccatcgagtacgccctgatccgggacgtaaacgatcaaccctggcgtgccgacctgcttggccgcctactgcacggcaagctggcccatgtgaatctcatcccgctcaaccccaccccgggcagcaagtgggatgccagcccgaaaccggtcgaacgggagttcgtccggcggctgcgggaggccggcgtggcggccacggtgcgcgacacccggggccgcgagatcgacggcgcctgtggtcagctggccgccggggagttgacgcaggcgggcgcagtgggcgtcgcagccgacgcggaggtggcacagtgactgggcggacgtcccagcgagcggagtgggagacgttgtgacgagtcagggacagcgtttccggcggcgcgcactgcgccggggctacaaggtcgacgaggtcgacgccttcctggaccgggtcgaggcgaccctcgccggtgagcaggtcggcccgccggtcggcgcccaggaggtgcacgacgtcgtcttccgggtgcgcttcggcggctacgacgagtggcaggtggacctgcacctcgaccgggtggagcggcagctcgccgagttcgaggagcggggcggccgcccggtcgacccgatgcgtgactcgatgcgcagtggcctgaccgccgaccgcaccggcggcttcgaccgcggtgagatggaccgcaccggcggtttcgaccggaccggtggcttcgaccgggccggcgcggccggtcagccttcgggtccgccggcgatgtccggtcccccgtcccgcaacggtggcatggccggtgcgggcatgggcgggccggggccgaacggtccgcagttcggtggtcccggtggcccgggtggccccggtatgggccagcagcagtacggcaaccccgggatgaacgccggcatggcgcagaccgagcggctgcccgccccgatccgcgacgaccggatgatgccgccgccgatgggtggccagcagctgccgcagcgcccgcagatgcagcaacccgacccgtatggcggccgttacgacgagccgacctcctacggcggtcagccgcagctgccgcagcgcggcgccccgcagggctatgaccagggcggctacgacgagccgacctcgtatgccggtttcgagccgggccggcacggccgcaccgacatgaccgccgagatccggatgccggaccgggacccgcggggtggctacggcggcccgccgatgccgcccggcccgccgatgggtggcggcccgatgcagcagcctccggccgggatgccgggttcgccgatgtcgggtgccccgatgagcggcccacccggcgggtacggacagccgcagcagccgcagctcggcccgccgatcggcgagccgggtggcgagctgtaccgcgtcgaccagttgcgccgcacgttccagccgcgacggttcggcagcggttacgacccgatgcaggtggaccggctgttcgagggcatcctgcaggcgatgaccgggcggggcccgatgccggtgaacgtgggcgagctggacatgctgcagttcggcctggtacccaacggctacttcgaggccgaggtcgacgccgcactgcgcgaggtcaaggacatcctgacccggcaccggtgaaagaaccgcccggcgccggtgaaagaacggcccggcgccggtgaaagaacggcctggcaccggcgagagcacgagccggcacagtaaaagcaggtaaaagaaggcgataacgagcgagggccctgacaaagggccctcgcgccgttcacggaacgtcagtcgttggcgcgcagaccggtcttgcgcagcaccgcgtcgccgatcacggcgaggatgagcagcaccgcgatcacgacgagccacaccttctcggtgttgccctcctggttgccccagaagtacatcagcagcaccacggccgagatgatcgcgccccgctgggcgcgccggcggttggtcggcttcagctggtccggagcgtagacgtcctcgtgttcttccaacgccgacacgtcggtcctcctcgtcgatgactgagctcgatgatctgagcgtcgcccacagtctgtcacggggtcgccgggcggaacccggcaacccggctgtactttcgatgcggtcacacacccgccgagcagaggagcgacaagtgcggatcacgggcaccggccatgcgagcatgcggatcgacacggccgcgggcagcattctgtgcgatccgtgggtgaatccggcgtacttcgcctcttggttcccgtttccggacaactcgcagctggactgggagacgctgggcgactgcgactacctgtacatctcgcacctgcaccgggaccatttcgacgccgagcacctgaagcggttcgtcagcaagaaggcgaccgtcctgctcccggagtacccgaccagccagctcgaggacgagctgcgggcgctcgggttcaccagcttcctgcggacgaagtcggacgaggtgcacgagctcgacggcggcctcaaggtgatgatccaggcgctgatcagcccgaccgacggcccgatcggcgactcctcgctctgggtggagtacgacggcgtccgggtgttgaaccagaacgacgcccgccccaccgacctggtccggttcaccgagctgggccacgtgcacgcgcacatgctgcagttctccggcgcgatctggtatccgatggtctacgagctgccggagaacgcgaagaccgcgttcggcaagcagaagcgggagcgccagttcgaccggacctggcgctacatcgacgacctgaaggccgatcacgtcttcccgatcgccggcccgccgtgcttcctcgacgacacgctgtggcagttcaacgacatccacggcgacgagggcaacatcttccccgaccaggcggtcttcctggaggagtacgcgaaggtcggcggcaccaacggcatcgtcctgctgcccggcagcgtcagcgagatcaccgcgaccggcacggcgaccaccgagcacccggttccggtcgacgagttcttcgcgaacaagaccgcccacctggaggagatgcgggcccgcaaggccccgatcatcgaggcggagaaggcgtcctggcggcacccggagatcgacgtcctgggcgcgatgaagaagcggatcgagccgctgctcgaggagtcgctctacatggcgaacggggtcggcggcccggtccggttcgacctgaccgactcgttcggcccggacggcgaggtggtcgagtcgatcgtcgtcgacttccccggcaagcaggtccggcagtacgccgacgagaaggtccggtatcgcttcaagaccggccgcgcgctcatcgagcacctgatccacatcgacgagggcgactgggtcaactcgctgttcctgtcctgccgcttctccgcggcccggatcgggcagtacaacgaattcgtctacgcgttcttcaagtgcctctccgaggagcgcctgcagtacgccgagggctggtacgacgagcacgagaaggcggtcgacgccgaggacatccagttcggcgactggaccgtgcagcgccgctgcccgcatctcaaggccgacctgtcccgcttcggcatcgtcgagggtgacgtgctcacctgccagctgcacggctggaagttcgacctgcccagcggccgctgcctgaccggcgtcggccacaagatccgggcgcacaaaacccaggatcaataacaggatcggcggtacgacgtgggctccgccgccacggcaacggtgctcacgtcgtacccccgcaatcggctattgaaggtcttggagcagacgcacagcggcgttgtggccggcggcgccgatcacactgcccgccgggtgggtgccggccgagccggcgtaaaggccgtcgacgccggtgaaatacggcatgcgccggtcgaaggcgacagtgttgtcgaggtggtggatgtgcccgccggtgatcccgaagtgctgctcgatgcccggtggggtgagcgggaacacgtcggcgaccaggtcggacgtgcccggcgcgtaccggtcgcagatcgccagcaggcgatcgatgtagccgggcagctcggcctcccaggacgatccggccggctggaacggcaccgactggacgaaaagcgcggacgaatggtgtcccgcctcgtcccgcagcgacgggtcgaccgtggtgtgcacgtaccactcgatggtcggctcgtcgggcaggcgaccggcctgcacctgcgcccacatgtcccgcagcgcggccatcggcgagtcgccggcgccgggcagcaggtggatcgtggagccgaacggcgacggcgcgccctccggcaggcagctgaaccgcggcaggtcccgcagcgcgaggttgaccttgagcgtggtgcccggccggcgcaccgactccaggtgctcgaccagcggggccggtagcgtgccggccgggaccagcgacatcagccggtacgggtcgcagctgccgaggacggcccgggcgcggacctcgcgcccgtcggcgaggaccaccccgctggccgcaccgccgtcgatcgtcaccgaggtcaccgcggcgtcggtgaacagccgggcgccggccgcccgggccgcgtcggcgaagacccgggcgacggtgcccatgcccccctcggcgatcatccaggtgctgtccgcgcccgggagccggcacatgttgtgcaccaggaagttgtgcccggtcccggggtcgtccgggccggcggtgagaccggacaggccgtcggtcaccgcgtacatgctggtcagcaattcgctcttgaagccgaatcgggccaggtagtcggcgaccgagccgcggaccaggtcgaggaaggtgctctgcagctgcgggcggatgtgccggtcggcgatctgctcgacgctgcccggctcctccagccaggacggcgccaggtcggcgcgcagcgcggcgatctccaccgccatcgcctcgtcggcggccgcgtcgcggggcgagaagaacgtctccagctgctgccgggtggcgtcccggtcgcggccgaacagcaggtgcggcgagccggccgggcccggggtgggcaggaagtagtgcgggtcgcggcgcagcatcgggatgtcgacgtcgagcttgcgcagcagctcgggcggcatcaggccgagaaggtacgaaccggtggactggccgaggccgggcacgcgggggaacgggtgctcggtgcgggtcgcgccgccgagcaccccggccgcctcgagcacgacgacgtcgagcccggcgcgggccagcaggatcgccgagaccaggccgttgtgaccggatccgatgatcaccacgtcggcgcggtcgggaatgggggtcatgccgagcgacggtacctcgctcaggtgacgtccgccctcggtgattcgtccgttaaatgtggcttgacggcgtgcgttgccgcgaatccgacaagaacgatcgtgtggaacacgtagagccacaggccgaccgcgaccgtcccgccgatcgcgtcgaaccctccgaacggcgtgcccagattcagcggcagcgagcagaacagcacgaacccgtgcaggaacccggacaggttcgcggccgtgaacgagccgatcaggacggtcggcagccacggcgggcggcccggcgcgacgtaccggaagacccagaccaccaccggcgtcaacagcagccagacggcgaggaaggagagcaccacgccgagcaccgaccaccagcccccgcgcacccacaacgcgctggtgatcggcagcgccaggaagagtcccagcagcagcgccggcgtggcggccagcaggggcagccagagcaggcggccgcgccagccgaccagcgactcaccggtgtgccggtagatcgagacgaacgcgcggcgcaggccctcgccgtacagggtggccggcagcaggctggccagtgccagcatcggggtcaggtgcagcccggcgtcgatcagggcggccaacgcccgcggcgcgccgatctcgccgggcagggcggcgatggtccggccggtcagccgccggatccggtcggcgccggcgatcaggctggtcagccagatcccgagcagcgcgatcgggaccaccgcgatgccgctgtagaaggtgaccgcggcggcgtgcagcgcgaggtcgcgcccccgcagcagccggaaggaaggcaccttgatccgcacaccaagccaactacccagccgcgcccccgaatccaccgtccggggttgtccacaggcgggtggacgaggcacgcgacggtaggctgagcccggcagaatgcctcccggaggtggatccatggccatgcccgcgcctgagcagtcattcgacatcctcggcaagctgaaccagccctggaccgcccagatggccgttgacctgctgcccgaggccaacggtcccaaggtcgaagtctttcgcgggagcgtggtggtgacccctcatgcccgatatgaccaccaggatgtccagctcgagctggcctaccggatgaaacaggccgctcggaaagccggattgtgggtctacgccgaggtcaacatcgtctccggagacgacctgttcatcccggacctggtggtactgcgccgatccgggggtgggaagaccaccatgccgatcgcggaggcggttctcctcggcgagatcgtgtcgaccgggaaccggcgaaaagacgtggtcgaccgcccgcgggagtacgcggccgccggggtgccctactttttgcgcatcgacttccggaatcgggtgccggcactggtcctgcacgagctggccgacggggagtatcaaccggtggcggcggccgccgcgggcggcaccttcgagatgcgcgagccgttcccgttcgccgtcgatccggaggagttgctcggcgagcaggactgagtgcaggtgccgggcagccatccgggaagatggcggcatgcgtgagcttgtgctgctggggtcgaccgggtccatcggcacccaggccatcgatatcgtccggcgcaacccggagctgttccgggtggtcgcgatcggggccgggggtggcaacgtcgcgttgctcgcggcgcaggcgctggagctgggcgtcgaggtggtcggggtggcccgggcctcggtcgtgcaggatctgcagctggccttctacgccgaggcgcagaagcgtggctggtcgtccggcgacttcaaactgccgaagatcgtggccgggccggacgcgatgaccgagctggcccgctggccgtgtgacgtcgttctcaacggggtggtcggcagcctcggcctggcgccgaccctggccgctctggagtccgggcggatccttgcgctggccaacaaggagtcgctggtcgccggcggcccgctggtccggcggatcgccaaggacgggcagatcgtcccggtcgactcggagcattcggcgctggcccagtgcctgcgcggcgggcgggccgcggaggtgcgccggctggtgctgaccgccagcgggggagccttccgcgggcggcggcgcgcggagctgacgaacgtcacccccgaggaggcgctcaagcacccgacctgggacatggggccggtcgtcacgatcaactcggcgaccatggtgaacaaggcgctggaagtgatcgaggcgcacgagctgttcggcgtgccgtacgacgacatcgcggtgatggtgcacccgcagtcggtgctgcattcgctggtcgagttcaccgacggctcgacgctggcccaggccagcccgccggacatgcggctgccgatcgcgctggcgctggcctggccggaccgggtgccgggggcggccgccgcggtggactggacgctggcgcacaactgggagctgcgaccgctggacgacgaggcgttcccggcggtcgagctggccaaggcggccggccggtacggtcgctgccgtccggcgatcttcaacgccgccaacgaggagtgtgtggccgctttcgccgccggtcggctacctttcttgggcatcgtcgacaccctggaacgggtgctcgcggcggccccggatttcgcggagccgagtaccgtcgatgacgtgctggccgcagaatcctgggcgcgtgcccaggcacagcggacgatcgcgactgtggctgaaggagcctgatgctgttctggctgggttgtgcggccttcgcgctgaccatcctgatctcggtgagcctgcacgagctgggtcacatgatcaccgggaagcgcttcggcatgaaggtgactcagtatttcgtcgggttcgggccgacgatcttctcgttcaaggtcggtgagacggagtacggcctgaaggccatcccgctcggcggcttctgcaagatcgtcgggatgaccccgcaggacgacgacgtcgcgccggaggaccagcaccgcgcgatgtggcggttcccggtctggaagcggacgatcgtgatgtccgccggctcgattacccacttcctgctggccctggccggcgcctggttcatggccttcttcgtcggcctgcccaacatccacctcccgcagacccgtgccgagcagcgctcctggccggcctacatccaggtcggcgactgcctgccggtgcagaccgagctcaagaagctggacgccgcggcgcagaaggcggcggcgagcgccaagtgcgagccgggcgtcaacggcgcgatcgtcgcaccggccaaggccgccggcctgcaggacctggaccggatcaccaaggtcggcaacactccggtggccaactacggccagctcaccgacgcgatccgggcctccacggccggcccgaccgtcttcgagtacgtgcgggacggcaagccggccagcaccaaggtcaacctgatcagcgacgagcgcgcgccgatcgaggatccgaagggcaaggtcaccctggtctcggtcgccggcctggactgggacaccgaccagccgttggtcaaccactacaccgcggccggcgcgttccgcggctccggtgagtactcgtggtatctggtcgagggctcgttcaaggcgatggccaagatcccgcagaagattccggcgctgtggcactcgatcaccggcgacgagcgtgacccggacaccccgatcagcgtgatcggcgccagccgcctcggcggcgaggcgatcgagaagggggtgcccgaggtcttctggcagatcttcatctcgctgaacgtcttcatcggtctgttcaacctgctgcccctgctcccgctggacggtggtcacatcgccatcgcgtggtacgaacgggtgcgctcctggctctaccagcgactccggcgacccgatccggggcgtgtcgactactacaagctgatgccgctgacctatgcggtcatcctgatcggtggcgcgttcacgctgctgaccgcgaccgccgacatcatcaacccgattacgatcttcaagtgagtgagtctccagtgaccgcgatcagtctcggaatgccggccgtccccccgccgccgctggccccgcgccgccagagccggcagatcaacgtcggaggagtcctggtcggcgggggcgccccggtcagcgtccagtcgatgaccaccaccctcacctccgacgtcaacgcgaccctgcagcagatcgccgagctgaccgcggccggctgccagatcgtccgggtcgccgtgccgtcccaggacgacgtcgaggcgctgccggcgatcgccaagaagtcgcagatcccggtgatcgccgacatccacttccagcccaagtacgtgttcgccgcgatcgacgcgggctgcgcggcggtccgggtcaatccgggcaacatccgccagttcgacgacaaggtcaaggagatcgcccgggccgcgtccgacgccggcgtgccgatccggatcggggtcaacgccggctcgctcgacaagcggcttctcgagaaatacggcaaggccaccgccgaggcgctggtggagtcggcgctctgggagtgctcgctgttcgaggagcacggtttccgggacatcaagatctcggtcaaacacaacgatccggtcgtgatgatccgcgcctaccgtcagctcgccgagcagtgcgactacccgctgcacctgggcgtgaccgaggccgggccggccttccagggcacgatcaagtcggcggtggcgttcggcgcgctgctcgccgaggggatcggcgacaccatccgggtctcgctgtccgcgccgccggtcgaggagatcaaggtcgggcagcagatcctggagtcgctcggcctgcgcgaacgcggcctggagatcgtctcctgcccgtcctgcgggcgggcccaggtcgacgtctacacgctggccgagcaggtgaccgcggcgctcgacgggttcccggtgccgctgcgagtggccgtgatgggctgcgtcgtgaacgggcccggggaggctcgcgaggccgacctcggggtcgcctccggcaacggcaaggggcagatcttcgtcaagggcaaggtgatcaagacggtgccggaggcggtgatcgtcgagacgctggtcgaggaggcgctgcggctcgccgacgagatgggcgcggagctgcccgacgagctgcgcgagctgctgcccggtcccacggtcaccgtgcactagtcgtacacgctggaaagcccgggtttctcacgaagcccgggctttcggctgtctcagaacaacacggtggcgaaggcgccggccgaggtgaagccgcagcggtggtagacctgacgggcggcggtgttgtagtcgttcacatacaggctgaccgtgggcgcgacccggcgcagcgcgtcgtcgaccaccgcggccatcgccgcggtcgcgatcccgcgcccccgatactccggatgcacccagacaccctgcacctgcgtggtgcgccgggtgatgatggccagctcggccttgaagatcacctggtcgccgatgaaccgggcgtaggcccgccggcccttgaccagctcggcgatccgccgccggtagccccggccgccgtcgtcctgcagcggtgagaccccgacctcctccgtgtacatcgccacggcggccgggaacagctgatccacctcgcccggccggaccagacgcacctccgggtcggccggcacctccggcgcgcggtcggtgaccaggagcggctggtggggccgcacgtcccgggcccgcccccagtgcacgctcagccgatcccacaggtcgaggaccgcctcggcccgcccgatgatcgacgagcagatccgcggctcggtgctgagcaggtcggcgaacgccgccacggccggcgcggtcgcgcccaccggcaccaggtgcgcgcccgaccagatgatcgactcgacgcgatgggccggctcatagccgtagatgcgcccgtcggaccgccaccagttcagcccgtgtgtggcgacccgctcggcgatctgggcacccgcataggggtcggcgtccagaatccgctcgaccgacacgcgctcgggctcaccgagctggcgaatgggcaccgtcaacacagctaccacattgccagatccacacaccttgacacgcatggcaaccccatgagttcggaaacccttgcggccgacacgttgccgatatatcgtctaactatcgacaacagaacggagaaggtcatgaggttcatgcacgagggacacgagcggcaccacggacacgggcgtcgcatgcgcggcttcggcttcccgcccggattccccttcggccccggcggtcccggcggcttcggtccgggcggccccttcggccccggcggcccgggcggcgacttcggtggccgcggcggccggcgcggtggccgcggccgggtcaacgtccgccccgccgtcctggcgctgctcctcgagcggcccatgcacggctacgagatgatccaggagctggacgcccgcaccaacggtctgtggcggcccagccccggcagcatctaccccaccctgcagctgctcgaggacgagggcctgatcgaggccaccgccgacggcggccgcaagagctaccggctcaccgaggacggccggcccgaggccgagaccgcggcacagaacccgccgtgggcccgcttcggcgacgacaccctcaaccaggtccaggacttccgcgacgcggcggtcgggatcttcggggcgctgaagcaggtgggcttctcggggacgccggagcagcggcagaaggcgctcgaggtgctcaacgagacgcgccgcaagctgtacgccatcctcgccgacagcgagtgaacgggcacccgcatcagtggcgggtcgtcgacggccggacggtggctggtccggatccgccgtgatggagcgcatccctcggggtgcgctcctttgcttgggtacgcggatcgcaccgttgccgcgccgtgccgttgccgtgccgtggggtgatggcggctggtgcttcgtgcgtatgggtgccctggtcgctcaggccggtcggccgcgcattgcctgccccgtcggccgcgcatggccggctcgccgcgtctggtccgcccgccggccccgcaaggcgtgctcgccgcgcatggcccgcccgccggccgcgcatgaccggtccgccgtgcatgacccacccacccagggggcctccgtcccggaccattatcgtccgaaaccgtcagcctcgcctgaggcctgtggataacgtcagtcgaattcggtcacgcccagcagccggccgagtgctgacctgccggtcggtgtgacgcggaccgctcgcccggacccgatgcgggtgagccagccgtgggccaggaaggttcggcagatccgggcgccggccagaccgccgaggtgggggcggcgttcggtccagtcgaggcaggcgcgggccagcgggcggcggttggccaacaggtcggcgggagtcagatccgcgttcgcgcggagccaggtcagcccgctgtcggtgatcgcgaacccggtgtcctggtcgagcaggccggcgctggtcagggcgtcggtgagggtgacgccgaggcgcccggcgaggtggtcgtagcacgtgcggccccggcgcagggcggcgtcggcggtggcggcccgcagggtgcggaccggcggagggccgggctggaggcgggcggtgagatcttccagcaggacggccactgcggggtcggcgagccggacgtagcggtggcgaccctggcgggcctcggtgagcaggccaccggcgatcaggcggtccaggtgctcggtggcggtggagcgggccacaccggcgtgggtggccaattcgccggcggtccaggcgcggccgtcgagcagggccaggcacatcgccgcccgggtgcggtcggccagcagcgcggcgaacgcggccagatccgaggcgtcaatcatgcgcccattgtcggaccgcgtcacttcggcacctgccgaaccgtcaccgccgacggcccgcacccggatcgtcggcgcgggggcacgcccggctggtcggcggcggctcgcacccggctggtcggcgctggcggccgcgaccggaccgttggcgctggcgaccggaccgttggcgccgggggtccccaccggaatcgtcggcggcggcccgcacccggatcgtcaggactaacggcccagtgccgcgatcaactcggtcagggccgggaaaccgccgcgctccagctccggcgtcggcagcagcgccatcaccgggacggtgatgccggcctccgcatatgcctggacccgggcccgcacctcgtccggcgccccgtgcacgatcagctcgtcgaccagcgcatccgggatcgcggccagtgcgcccttgcggtcaccggccgcccacgcctgccacatcggctccaggatttcggcgcggcccagccagcggtggaaagcggcataggccgggacggtcagatacgacgtgatcaggcggcggccgagggtgcgcgcgtagccggcgtcggtggtcggcaccacgaagatccgggcggcgaccgcgaagtcgggcccggcctctttcgtctcggccagggcggtgtgcacgtcggcggccgacagccagttgaggatcaccccgtcggcctcggcggcggccaggtgcagcatctgcgggcgcagggcggccagcaggatctgcggcgggacggccggcgggcgttccagccggaagcgcttgacggtgaaggtggggtaggcctcgtcgaccaggtcaccggtcagggcggcgcgcaggaaacggagggtgtcgcggctgcgggcgaacggctggacgaagtcggcggcgttccagtcgccggcgacgaccggggaggacgcgccgatgccgagctggaagcggccgggggcggtctcggcgagggcggccgcggtcatcgcgagcaggccggggccgcgggtgtagaccggggcgatggcggtgcccaggcgcagccgcggctcccaggcggcggcaagggtgagcggggtgaacgcatcggtgccggcgacctcggaggaccaggcgtcggtgaatccggcgtcggccagtgccgtgaaaacggcggcgtggtcgggcagcggaacgccgccgagcggaacggtcatgccccatcgcatcgacatgccctcgatcctgccgtccggaccgtcgtgatgtccaccacctgtggatatcccacagccgggacgggggtatgtttttgaactgaccagtcagtttaattgaggagtcgtcatggcggtgctcagcgcggccggcgccgggatccggcaccatcggcgctggctcgtgcgcgacctggacctggtggtcgagccgggcgagacggtcgcggtcgtcggcccgcccggcagcggacggaccagcacgctgctggcgctcgccggtcggttgcggttgtcggcgggcacggtctctttgggcggtacgtcgtcagtcggccatgtgcccggtgtcaacgaacccgaacccgctctcacggtcctggagcacgtgcacgagcggctggccctgctcggccgcagacggcgcgaggccacggcggtgaacctgcacggactggagccggatcggcgcgggcgggagctcacgccgtaccagaggcaggttctggggttggttctggccctgatggcgaagcccgcggtgatcgctctcgacgacatcgagagcgggctggacgcgggggagcgggcgcggctgtgggagctgatcggctcgctgacggccgcggggatcgcgatcgtcttcaccgcgcgtgaggtcgaccccgccgcggtctcccaagtggtgcgggtggggcacccggaatcgcctcaggaaccggaagcgccgaaggaaccgaaggaaccggaagcgccgaaggaaccggaagcgccgaaggaaccggaagcgccgaaggaaccggaagcgccgaaggaaccggaagcgccgaaggaaccgaagggaccggaagcgccggaagcaccgaaggaaccggaagtgccgaagaagccggaaacaccgaaggaaccggaagagccggaatcaccggaagaaccggatgaaccagtgaaggccgaagaaccggagacgccggaaacagcaggaaagccggaagaggcggagaggaaagcgaaatgatctcgctggccggaatggagttccgccgtttcacccgcagcaagctgaccgccgccgccctcgctgtcctcgccgtcgtccccctgctctacggcgccctctacctctacgccttctgggacccgtacggccacctcagccacatccccgccgccctggtcgtcgaggaccagccggcccaggaccagaagggcaacccggtccacgtcggtcaggacctggcccagaagctgatcaaccgcaaggtcttcgactggcacgtggtcgacgccgccaccgccgacgccgggctcaaatccggtaagtaccagatcgagctccgcatccccgccgacttctccggcaccctcgcggacgcgccgaatgcgaagaccgacccggagaacgcgcggctcagcgcggtcagcgacgattccaccaactacctttccggcgttttcgcccgcaccgccttcgatgaggtccgggcggccgtcagcgccggcgcctcggcgaagtactacgaccagatgctgatcggtttcaccgatctgaaggagcagaccgagaaggccgccgacggtgccgacaagatcaccgacggggccggtcagctgcacggcggcgccgcgaaggaggcggccggcgtcgacaaggcgcatgccggcgccgggcagatcgccggcaagctgaccaccgcgggccagggcgccgaccagctcgccgacggcctgcgccagctggaggcgggtgccggccagctggcgtcgggcaccgcgcaggcggccggtggcggccgccggttggccaacgcggtggacggcgtcgcggaccgggcggagccgatcctgcgcgcgaacgcgggaagcatcgagcacgccgcgacgctggtcgcgaacggcgccgatctgctcgccgcgaatgtcggcgcgatcgacaccgcggccgaccgggccgtgcgcgacgccaaggagctgcgcgcctacctggacacggtcccgtccagcgcgtacgcgaaacacctggccgatcgcctggtcgcggacgcccggcggattcagcgcaaggtgcacgccgccgacctcgccgggctgcgcgcccagctgcgggaggtcgcgaagaccgcccgcgcggtcgccgccgccgcgccgcacctggccgacgacgtggccaaggcccgctcccaggtggatcagctggccaacggtctggaccggctggccaccggtgccaagcagctcaagtccggcaccgcgcaggccgccgacggcgccacccggctccggaacggcgtgtaccgcctggccagcggggcccgccagctcgacaccggtctggccaagctgtccgacggcgggcacaagatcgccgacgggctcgccgacctgcagaacggcgccggtgagctggccggcaagctcgccgacggggcggggcagatcccgtcgtacgacgatgccgcgaagcggtcgggcattctggccgatccggtgtcgctggaccgggcggtgcgcaacccggccggcacctacggcgtcggtttcgcgccgtacttcctggccctggccctctgggtgggcgcgatgatcaactacatgctgctgcggccgctgaaccgccgttatctggtctccggcgcgcccgcaccccgggtggcgctggccggactgctgcccggcgtgctgatgggcatcattcaaacgatcatcctgtacgtcgtcgtgcacttccgtctcgggctgtccccggtccacccgtggctgaccctgggcctgctggccggcaccgcgaccgtcttcgccgccctgatgcagctgatcggcgccgccctcggcgcccccggccggatcatcgcgctggccctgctgatgctgcagctcacgtcgtccggcggcacctacccggtgcagacctcgcccggcttcttccagggcatccacccgctgctgccgatgacgtacgtggtggacgcggtgcggcacgccgtcgacggcggcgagaccggcccgatcgtgcacggctcgctggtcctcgccgggttcggcgtggtggcgtacctgctcaccgtgctggtcgcgacccgcaaacgccggatgcgcgtcgccgacctgcaccccgagctggtcctctaacctgatgccgtggcgatggacggacgcagtcgccggcgtggggacacccggcagaagctgtacgaggccgcggtggagctgatcgccgagaagggtttctcggagaccaccgtggacgacatcgcgctgcgggcgaacgtcgccaagggcaccgtctactacaacttcaagtccaagaccgacctgttcgaggagctgctgcggcacggcgtcgggctgctcaccgacgagttccgcgcggcggtcgtgggcctgccaccccgggaggcggtgcgggccctggtccgggcccaactggcgtacatcaagaagtatcgcgccttcgcccagctcctcgtctccgagatgtggcggaccaaccgtgagtggcagcagaccctgatcctgctgcgggagcaggcgatcggcgtgatcgccgagtcggtgcaggccggcgtcgacgccggcgacctcccggccgacctggacgtccgggtcgcctcggccgccctgttcggcgtcggcctggtggtcgcggtcgactggctggtcttccagccggagcgcccgatcgaggacgtcgaggcgtcgatgctggcgatcgtccgccgcgtcgcctgaccccgggccgctgcatccggcgggcgtccggttttcgtaggactgtcagggccaggacacggccggctcgctgccgcagacttggcgacgtgcaagcgtgggagttcggccggatgctgcgccgctggcgtgaccgcgtcaccccggaggtcgccggggtgcccgccggccgccgccggcgcgccgcgggtctgcgccgtgaggagctggccaccctggccggcatctccaccgactacctgacccgcctggagcagggccgcgccaccgccccgtccgcccaggtcgtcgagtccctggcccgggccctgcggctacccaccccggaacgcgacctgctgcaccagctggccggccacgccgcccccggccacgacgtcgtccccacccggatcaccgccagcgtccagcgcctcctcgaccgcctggcgcacaccccggtcgccgtccacgacgccacctggaccctgctggtggccaacgccccctacaacgccctgatgggcgacaccaccacctggcacggccggcaccgcaacgccgtgtggcgcagcctcgccggcacccccacccgggtcgtgtactccccgcgcgagagagccgaccacgaggcccgcatggtcgccgaactgagtctgaccgcctcccgctaccccgccgaccacaccctgcgccgcctgctccacgacctggccacggagtttccgcgcttcaccgagctgtgggagtccaccaccgcgccgccacccagcgacccggccaaacgcaagatcgtcgaccacccggcggccggccgcatcaccctggactgcgacaccctgctggtcgccaccgatgacctgcgcatcaccgtctacaccgccgagcccgcgaccgacgacgccgaccgcctcgcgctcgccatcgtcctcggcatccagccgttcaccccctgacgggtcgctgccggagtgacgctttcggcgggtcgccggccgggtgaaacaacgcctcagggattgacggggcttgcgttgccgcaggtcagtctgacgtttggctaaaaaatctacagcggcgactctagaaatccggcggcgacgggcttatctttgatccgtcggccacggtcggcaacgcaactggcacagacgctgagttggctaaggaggacgagataccgcagcaacgcgtcatcaccacgtccccgacccgacaagaggtgatcgcagccgatgcccatcactccggtcgactgctagcggcacgcagccggtcgaccacattcgccggacgagagagccggcaccagaattgaaaagccagggccccggttacccgccggggccctggactctgtgcatgaggggaccatgcccagcaggatttcggatgacgccgacctcccggcgtacacgatgggccgggccgccgaactgatcggcgtgacgcaggccttcctccgcagtctcgacggcaccggcttgatcgaaccggaacggtcggccggcggccaccgccgttactcccgtcaccagctcgccctggccggccgggtccggatcctgctggacgagggtctcccgctgaccgccgcggtccggatcgtcaccctggaggatcgcctggacgccgcccatcagcggatccgggacctgggcggcacgctcaccgcgggcgaggacgcctcgatcccgatgcagacccggggcgccggcccgagccgtgccgacgagggcggggcgggggccggggagatgcgagcgcgacaggacgtgtaatcgtctctgcatgccatcgtggaacgtcgaggagtggcggcggcccggaccgaccgcgcagcagcgccgcaacgacctgctgaccgggctgggggccaccgggctcgccgtgatcagcctgttcctgctgcgcagcaccggctacttcgagagtgaccgggcgccggcgatccccgaggaggtcttctgggcggtggccacgacggtgccgctggtctggcggcggcggttcccggacgcggtggcggtcgtcatctcggtgttcttcatcgccgggcagatccggttctcgcaggagcagatgatcgtcaactacgcgctgttcgcggcgatctacacgctcggtgcctgggggcgcaaccggcagcgtgcccggatgatccggctcgggatcgtggcggtgatgttcgcctggctgaccctgtcgttcgtgctgtaccacgacgccgtgtccgcgacgatgaccgacaagggctcgggtgagctgtcgaaactctggtcggcgatcttcatcagctacctgcagaacatcgtctacttcgggttcacctacctgatgggcaacgccgcctggcgctccgtctggcgtcagcaccagctggccgagcaggccgaggagttgcgcgcggcgcaggcggcggcggccgggcgggcggtgctggacgagcgggtgcggatcgcccgggagctgcacgacgtggtcgcgcaccacgtgtcggtgatgggcatccaggcgtcggcctgccgccgggcgctggaccgggatccggcccgggcggtcaccgcgctgaccgcggtcgaggacggcgcgcggaccgcggtcgacgagctgcgccggatgctcggcgcgctgcgcgccaccggcccggcgacacgggagtcgccgggcgccgggctcgaccgggtcgaggagatcgtcgagcgcgcacgggaggcgggcctccaggtcgatttcgggatcttcggtacaccggtgccactgcccgattccctgtcgcaggccgcctaccggatcgtgcaggagtcggtgaccaatacgctcaagcacgcgggggcgtccgggctggacatccggatccggtatctggccggggagttggagctggacgtggccgacgacgggcacggcggcgggggacgggccggcagcgggatgggactgatcgggatgcgggaacgggtcgcggtgcacgacggcaccctggagtgcggccggcgtaccggcggcggctaccgggtccgcgcccggctgccgtacgccccggcggccgtggagagtgccgcgtgagcatccgggtcctcctcgcggacgaccatcggctggtccgctccggcttccgggtcatcctcgagatggaggacgacatcaccgtggtcggtgaggccgccgacggggccacggcggtggagctggcactgcggctgcgtcccgacgtcgtcctgatggatgtggagatgccggtgatggacggcctggaggcgacccggcggatcgcggcgcagagcggcccgtcggtgttgatcctcaccacgttcgactccgacgactacctgttcgccgcactgcaggccggggccagcggattcctgctgaagaacggcaccccggaggcgctgaccgaggcggtgcgggtgctcgccgccggtgacgcgctgctcgccccggcggtgacccggcgggtgatcgccgagttcagcgcgccccggcagcggtcccccgagccgggggtacgcctcggcgagctgacgccgcgcgagcacgaggtgctggtcgagctggccggtggggccaccaacgcggagatcgccgccgccctgcacctcggggagaccaccgtgaagacccatgtcagccgggttctgatgaaactgggcgcgcgcgatcgtacgcaggctgtggtcatggcgtacgagatgggcgtggtgcgtccgtcgcgagaatgacccgcggcggtccttcccgggccggacgccgcaggcggccggaaagcctagcgtctctcgcatgaaccccgaactgagcgtcgacgcggtcgaccggtcgttcggtgagcggcaggtcctcaaggatgtgacgttcaccgtggcggccgggcggctcaccggattcgtcggtgccaacggcgccggcaagaccaccaccatgcggatcatcctcggcgttctggccgccgacgcgggcacggtgagctggcgcggcgagccggtcggccgggagatccgccagcggttcgggtacatgccggaggagcgcggcctctacccgaagatgagcgtcctggaacaggtcgtctacctgggccggctgcacgggctgggcgcggccgaggcccgccgccgcacgctcgctctactggaacgcctggagctggccgaacgggccgacgaccacgtgcagaaactgtcgctgggcaaccagcagcgggcgcagatcgccgccgccctggtgcacgatccggaactgctggtgctcgacgagccgttctccggcctcgacccgatcgccgtcgacaccgtggtcggggtgctgcgggaacgggccgccgccggcgccgcggtgctgttctccagccaccagctcgacgtcgtcgagcgcctctgcgacgacctggtgatcatcgcggacggcacgatccgcgccaccggcgaccggaccggcctgcgcgagcagtacgcactgccgcggtaccgcatcgaggtggccggcgacgccggctggctgcgcgaccagtccggcgtcaccctgatcgacctggacggccggcacgccaccttcgacctggcggtcgggctcgacgaccaggtggtgctgcgcgccgccctggaccgcggtccggtgcacgcgttcggtccggtccgccccaccctcgccgagatcttccgagaggtcatccagtgacgacattcgaggccgccaaactcgtcgccgcccgcgaggtccgggtcaagctgcgcgacaaggccttcctcttcagcaccgtgctgttcctgctcatcgtggtcgcctcgatcgtgctgccgaccctgctcgacgggggcgccaccaaggtcgccgtgaccgacaccgcgaccgtggcgaccctgcagaagagcggtttcgaggtacgggtcgtcgccgacacgcccgccgcggaagccctgatccgctccggtgacgtcgacgcggccgtgctgcccggcccggtggtggtcgccgagcaggaccgtccggacgacgtgatcgcggcgctgagcaccgagccgcagacccgctacctggagcacagcgacatcgccccggccctgaagatcctggtgccgatcgcgttcgcgatgctgttcttcttcacctcgttcaccttcggcatgcagatcgcgcagagcgtcgtcgaggagaaacagacccgcatcgtcgagatcctggtgtccagcgtccccacccgcgccctgcttgccggcaaggtcttcgccctgaccgtgctcgccttcgcccaggtcggcctgctggccctggtcgcgatgatcgggatgaccgccacggacgccgcccccggcctgctcaacgccatgatcccggcgatcggttggttcctgccgttcttcgtgctcggcttcgtcatgctggccgcgctctgggccggggtcggcgccctcgcctcccggcaggaggagctggccagcaccacggtgccggtgcagatgctggtgctgatcccgttcttcctggccctcagcgtcccgcacgacggcatcctgatgaagatcctgtcgtacgtgccgttctccgccccgatcgcgatgccgatccgcctgttcgacggcacggccgccgggtgggagccgatcgtcgccgtcgtcctgctggccgcgaccgcgctgggtctgctcggggtgggtgcgcgggtgtactcccgctcgctgctgcgcacccaggtccgcaccccgctgatggccgccctgcgccggtcctgacggcgtccggaaccgggggcggacgccggggatgtgccgcggataggctgcccgggcaggtgaagatccaacgggggaaatatggaaatgtggcttgcccgcaacggcaggaggtcgctgctgctcagtgccgtcctggtggcctgcgccgtggcggccgccccggccgctccggccgcggcgactccggcggccgtgccgagcggcgtgctgttcgacgacttccactaccgggatgccggggatccggcgctggccgtccacggctgggatgtccggaccggggccggcgggcccggtgtcgccgggacctggtcggcggacgcggtgagtttcccggcggatgactcggcacgcggcgggcaggcgatgcggctgcgggccggcaccgacggcaccgtcgggggaacgacgcaggcgcaggtgaacacggtgcggagcaagttctactcggggaccttcgccgcgcgggtcttcctgaccgacgcgccggtctcgggtgccgatgtcgatcggccggtgcaggctttctacgccatctcaccggcggcggatgcgcactacagcgagctcgatcacgaatatctgccgaacggaggctggggaaccaccgggccgcggcacttcaccaccgcgtggcacgatcccgatccggcggtcgaggaccgggtctccaccaaccaggcggggtcgctggccggcgcctggcatacgctcgtgatgaccgtcgagaacggcacggcagacttcttcgtggacgaccggaagctgctcagcaccgggtcgccgtactcgccgcgcgagccgatgatgatcaacttcaacgagtggttcgccgagtcggtggccggtgccggggcgacccgctcctgggacatgaaggtcaactgggtctactacaacagggccggagcgcagagcccggcgcaggtggcggcggccgtcgacggctactacgcgagcggcaccgacttcgtcgacaccgtcgcggccgggaccgtggcgcacgactacaacggtgacgggatcagcgacatttcgctgctctacgactacggggccacccaggcggccggctgcccggtcagcccgtcgcgggacaccgcgatgttcgacctgtccggccgggctgaccgcagcggcgggctgaccggcctggccacccagtggcggggcccgtgccaaccggtcctgccgcggttcaccacgtccggtgacttcaccggagacggcaggagcgacgtggcggcgttctacgactacggcagcgcgggcacgtcctgcccgggtgtcgaccgggtggcggtgctggtgtggccggccgacccggcgggcaccggcgcgctgctggagccggtcaccgcgtgggcgagttcctgcttcgggtcccggaccgcgttcttcgaacccggtgacttcaacggggacggcaagagcgatctggcattgctgtacgaccacggcgccggcaacctgcggatgctgacgctcagcgccaaggccgacgggagcggcaccttcgacggcgcggtggtccggtgggaggcgaccgactgggggaccggggtcaagttcgtcaccgccggtgacctcaacggggacggcaagagcgacctcgccctgttctacgactacggcacggcgggggccacctgtggcgggaactcgcaccaggcggtcttcgtcatgaccgcggacggcgcgggttccggcgcgctgagcacgccgatgaagggctgggagagcacctgcttcggtggcggcacgtcgtcggtgaaggccggcgacttcaacggggacggacgcagcgacctcggcctgctgtacgactacggtgccggccacgtcaagctgctcaccatcgcctcgggcccgggcgggctgcagggtctggccgcccggtgggagagcacccgctggggcaccggcacgaaattcgtgaccaccggcgactacaacggggacggcaagagtgacgtcgccttgctctacgactgcgggacggccggggcgacctgcaccggtgccgcccaccagatcgtctacgtgctgaccgcggacgggtacggcaccggcggtttcccggaggtggcgaagcggtgggagagcaccagtttcggggcgggcacccgattcgtcagctgagcaccgcgtacccgggcagtcgacgacgctgaccacggcggagcgggagtggggcggcggtgcggggcgggcgctgcgcggccggaaggccgcgtgcgggtgagagaggtgaccgcgccccgcaccgccgcagggaggttgtcgaacaacccgggcgaaacggtccctgccgaggggtccggttgctgccctgtcgccgtcaaggttcgcaccgcaacatggcgcgcggcaacgcaattaacgctgatcattgacggccgtaacacagcggagcgatcatcaccgaaacccgtggctcaggtcacaccttttcggcgtagggagctcgcgcaatgagcactgaaccggccgttagcagcagcgacgaggaacgactcgcgcaactcggatacaagcaggaacttcatcgccggttgtccggcttctccaacttcgcggtctccttctcgatcatctccatcctggccggtgcgatcacgtcctatgtgatcgcgatgaacgccggcggaccgttcgcgatcaccatcggctggctgctcgtcggcgggatggtcaccctggtggcgatggcgatggccgaggtctgctcggcgtatccgacggccggcgcgctgtactggtgggcggcggcgctggccaagcggaacaaggccgcgtgggcctggttcatcgggtggttcaacttcctcggcgaggtcgcggtgaccgcggcgatcgacttcggggcggcgatcaccacggcggcgttcctgagcctgaccttcgacatggcggtgacgcccgggcggaccttcctgatcttcctggtcatcatcgtggcgcacggtctgctcaacacgttcggggtgaacctggtgcgggtgctctccgatgtgagcgcctggtggcacctgatcggcgtggcggtgatcgtggtgctgctggccgtgctgccggatcaccacaagccggtctccgaggtgttcttcgaggtgaagaacgcgaccgggttcggcttcggcgcagcgacggtgtacgccgtcctgatcggactgttgatggcgcagtacacctacacggggtacgacgcgtccgcgcacgtggccgaggagacgcacgacgcggccaacgcggcgccgcgcgggatcgtgatgtcggtggtggtctcggtgatcgccgggttcgtgctgctgttcgcgatcacctggtcgatccaggactacgacgccgaggcggcgacctcgctccagttgccgccggcgcagatcttcatcgacgcggccggccacaacgtcggcaccttcctgctgttcatctgcatggtggcgcagtggttctgcgggatggcgtcggtgaccgccaactcccggatgtcgtacgcgttcgcccgcgacggcgcgctgcccggctcgcggctgtggaagcaggtcaacccgcgcaccggcacgccgaccaactcgatctggctgtgcgtgaccatctcgacgatcctggtgctgccgtcgctgtggaacaccacggcgtacgcggcggccacctcgatcgcggtgatcggcctgtacatcgcgtacgtcggcccggtcttcctgcgccgccgcaacccggacttccgggccggcccgtggcacctggggaagtggagctccctggtcggctggatctcgatcgtctgggtggcgatcatctgcgtgctgttcgtgctgccgaccgccggcccgatcacggcgaagaacttcaactacacgatcgtcgcggtggcgatcgtcgtcggcggcgcgaccgtctggtggttcgcgagcgcccggcactggttcaccggtccgcgctccaacctgctggaggcggcggcgcacggcgagcagaccatgccgacggccaacgactgataggactgatccatggatctcgaggacctggacgtagcggtcggcaacggttcgatcgacaccgtcctgctggcgctcaccgacatgcaggggcgactgcagggcaagcggttgcacgggcggtacttcatcgacgaggtggccggcgcgggtagtgagggctgcaactatctgctcgcggtggacgtcgacatgaacaccgtcgacggctatgagatgtcctcctggtccaccggctacggcgatttcgtgatgcggccggacttcggcacgctgcgcagggtgccgtggcagccgggcaccgcactggtgctggccgacctgttcgacaccgcgggacagccggtggcaccgtccccgcggcagatcctgcgccgccagctggaccggctggcggcgcacgggctcaccgcgtacgccgggacggagctggagttcgtcctctaccgggacagctatgagcaggcgttcgacaggcactaccggaacctgaccccggccaaccagtacaatgtggactactcgttgctgggtaccgcgcgggtggaaccgctgctccgcaggattcgcaacgagatgtacggcgcgggcctgctcccggagagcgccaagggcgagtgcaacttcgggcagcacgagatcgcattccggtacgccgacgcgctgaccgccgcggacaaccacgtcgtctacaagaacggggccaaggagatcgccgcccaggaggggatggcgctgaccttcatggccaagccgaacgagcgggagggcaactcctgccacatccacttctcgctgcgcggccgggacgaccggtcggcgatgctgggcgacgggccggcgcacctgagcgtgaccgggcagcgggcgctggccgggctgctcgccacgatgcgcgagttcagcctgctgttcgcgccgaacatcaactcgtacaagcgctatcagccgggctcgttcgcgccgaccgcgctgcgctggggcgtggacaaccggacgtgcgcgctgcggatcgccggccacggtcagggcatgcgggtggagaaccgggtgccgggcggcgacgtgaacccgtacctcgcgatcgccgcgctggtggccggcgcggtgcacggcatcgagaacgagctgccgctggaggacgagttcgccggcaacgcctaccgggacgacaccgccgggcgggtgccgggcacgctgcgcgaggccaccgagctctgggcgggcagcgcggtggcggaaagcgcgttcggggcggatgtggtcgcccactacgccaacatgggccgggtggagctggccgctttcgacgccgcggtgaccgactgggaactgcgtcgtggattcgaacgcctctaagtgtgaggatcttgacgtgggcacaactgacgtgatcaacccggcggacgggcgggtcttcacgaccgtaccgtcgctggacctgaccgggaccgacgcggcgatcgagcgggcccgcaaggccttcgggagctggcgcgcggtcgcgcccggggaccgggcgcggctgctgcgccgcttcgcgacggtggtcgacgaccacctcgaagagctggcgcaactggaggtgcgcaacgccggccacaccatcggcaacgcccgctgggaggccggcaacgtccgcgacgtgctgcactactacgccggggccccggagcgactcgccgggcggcagatcccggtcgccggcggggtggacgtgaccttccacgagccgctcggcgtggtcggcatcatcgtgccttggaacttcccgatgccgatcgccggctggggcttcgcgcccgcgctggcggccggcaacacggtggtgctcaaaccggccgagctgaccccgctgaccgcgatccggctcggcgagctggccctcgaagccggcctgccggaaggggtcttccaggtgctgcccggcaagggcagcgtggtggggcagcggttcgtcacccacccggcggtccgcaaggtctgcttcaccgggtccaccgcggtcggcaaatcgatcatggcgggctgtgccgaacaggtgaaacgggtgacgctggagctgggcggcaagagtgccaacgtgatcttcgcggatgcggatctggacaaggcggccgcggccgcacccggggcggtcttcgacaacgcggggcaggattgctgcgcccggtcgcggttgctggtcgaggcttcggtgtacgaccggttcctcgccctgctggagccggccgtccagaaattccgggtgttggaccctgctgacgagaagtcggagatgggcccgttgatctcgtccggccagcgggacgtggtcgcgtcctatgtcgacggcgcggaggtggcgttccgcggcagcgccgcattcaccgacggctggtggttcccgccgaccgtgctgctcgcctcctccgcggcggaccggcactggcgggaggagatcttcggcccggtggtcagcgtgctgccgttccgggacgaggccgaggcgatccgtctggccaacgacaccgagtacggcctgtccggctcgatctggacccgcgacgtcggccgcgcgctgcgggtctcccgcgccgtcgagaccggcgcgctcagcgtcaacagcaactcgtcggtgcggtactggacgccgttcggcgggatgaagcagtccggtctgggccgcgagctgggcccggacgcgctgctgtcgttcaccgatgtcaaaaacgtgttcctggctacgggagattaagtggagcgtttgcaggaccgggtcgccgtgatcaccggcgccggcagtggaatcggtctggccaccgcgcggcgcttcgccgccgagggcgccaaggtcgtcgcggtggacatctcgcaggaggccggcaaggcggtcgcgcaggaggtcggcggcgagttcgtggcctgcgacgtcagtgatgaggggcaggtcagggcactcttcgacggggtggccgagcggcacgggcgggtcgacatcgccttcaacaacgccggcatctcgccgcccgacgacgactcgatcctggtcaccgggctcgacgcgtgggagcgggtgctcaaggtcaacacgaccagcgtgttcttctgctgcaagtacgcgatcccgtacatgcagcggcagggcaagggctcgatcatcaacaccgcgtccttcgtggcgctgctcggggcggcgacctcgcagatcgcgtacaccgccagcaagggcggtgtgctggcgatgacccgggaattgggcgtgcagttcgcccgggagggcatccggatcaacgcgctctgccccggcccggtggccaccccgctgctcatggagttgttcgccaaggatccggagcgggccgcccgccgcctggtgcacgtgccgatgggccggttcgccgagccggccgagatcgccgccgcggtggccttcctggccagtgacgacgcctcgttcatgaccgcgtcgcagttcgtcgtcgacggcggcatcaccggtgcgtatgtaaccccgctgtgaacgtttagtcacccccgaggccgggaagggatctcttcacaggggtcgaatccctgctcaggcgggtcttggtccccgtctgggataggacagaggggcccgtggcgcggcaccgttgatttcggtgccgcgccccctgtccaggcgaccggaccggcgggcggtggctacggtggtgcgatgcgtccgatcatcggcataacgacgtacgtgatgcccgcctcctggggtgtctggcgtgacctccccaccgctctggttccctacgactacgccgccgcggtcacccaggccggcggccgggcggtgctgctgcccccggacgacatggacgccgaggtgctgcgggtgctggacggtctgctgctggccggcggcccggacatcgaccccgcgctgtacggcgagcggcccggcccgcacaccgtcacccatcccgaccgggacgccggcgagctgaccctgctgcgcgccgcgctcgaggccgacctgccggtgctcggcgtctgccgcggcatgcagctgctggtcgccgcgcacggcggcagcctgcaccagcacctgccggacgtgctcggccacgagcggcaccgggtggcccccggcgagtacagcgagcacgacgcggtcttcgtccccggcagccggatcgccgggttgatgggcgaggacgtgaccatcaactgcttccaccatcagggcgtcgccgacgccgggaagctcaccgtcaccggacgggccgaggacggcctgcccgaggcggtcgaggacccggagcggcgattcctgctcggcgtgcagtggcaccccgaggtgagccgggaccgccggctcttcggcgcgctggtgacggccgccgccgaacggagttgaggagggcaccatccccatgcgcagaccgctgatcggcctcaccgcatacgcccagcacgtgcagtacggccggaacgagctgatggccggcatgctcccgatgacgtacgtgcgggccgtgcacgccaccggcgggcgggcggtgctgatcactcccgacgaccccggcaccgacgtgctggaatcgctcgacggcatcgtcttcaccggcggcgccgacgtggacccggcgcactacggcgccgcgccacacccggagaccgaggtggacgcggtccgggacgccgccgagatcatgctgatgcgtgcggtgctcgacgccgacctgccggtgctcggcgtctgccggggccaccaggtgatggcggtcgccaccggcggctcgctgcaccagcacctccccgatctgatcgggcacgaccggcaccgcggcgcggtcggcaccgacccgctggccgccggggccggcgactacggccggcacgacgtggtcaccgcggacgggtcccgcgcccacgacctgttcggccggcagaccaccgtgaactcgttccaccaccaggcggtggccgaccccggcgagttcgtggcgaccggctggtgcccggacgaccgggtggtggagatcctggaacatcccgggcgcagcttcgcgatgggcgtgcagtggcaccccgagcgcaccaccgacctgcgggtcttcgcggcgctcacccgggccgcgctgatcagccgggagatcgccgcggcctcggtgtagcggcggtcacgtccccacccggccgcccgccgggtccggctgccggcccggtgttaacgtgccagcgggccggctttccccggcgaccccacctcacgggaggcatcgatgggcgtcctgcccgcccggctgcgcgtcgccttcgagcgcggcggcgagatgggccggcggatggccgagctggactggtccgcctccccggccggggatcccgcgaggtggccggacgagctggtcggcgcggtggtgacgatgctcgcctcgcgcacccagatcctgatcgcctggggcccgcagcacaccgtcctctacaacgacgcgtacgccgccatcgccggtggcaagcatccggcgtacctgggccggccgggccgggacatgtgggccgagacgtgggacacggtgcagcggctgatccgccgggtgcatgagagcgacgaggcgttctacgccgacgaccacccgttcctgatcgagcggcacggcttcctggagcagacctacttcgacgtgtcgttcgacccgatccggtccgccgacggctcggtcggcggaatcatgtgcatcgtcgccgagaccaccggccgggtgctcggcgagcgccgggtgcggatcctcggcgcgctcggccgccggctggccgacctggccgtgccggccgcgctggccgccgaggcggtggccgcgctccgggtcggctcgctcgacgtgccctacgccgaggtggtgctcgacgcggccggcgcgcacccggcgatccgggacgtgatcaccaccggccggcccggccgggtgccgctagctagctagggcgccgacacggtcggggcgctggtcgccggggtcaaccggcacctgcgcctggacgacggctaccgggacttcctgaccctggccgctgcggcgatcgcccgggcggtggccggcgcgcgggccgtctacgcggccgcggacaccgacgacgtgctggccgcgccgttcgccaccgggcaggtgaccgaccgggtgcgggccggcctggagttcggccgggtgcgccgggcgacggtcaacgggctgcgcgggctggtcgacgccgcggtcgcgctgagctcggtgaccggtatcgccgaggtgctcgacgtggcggcccggcacgtgcaggcgatgaccgcggccggccgggtggtggtctgcgtcccggacgcccgggccgagcgggacggcggtgccgaggcggacgccgagccggacgtgctggtgccgctgccggacaccgcgggggtgcagctcggcgagctgcgggtctggtccggcgcggacgggccggtgccgccggtcgtgttgacccagctggcccgcctgatcggtctgcggctggccaacgcccggctgtacgagaccgagcaccggatcgcccgcaccctgcagcacagcctgctgccgcagtcgctgccccgggtgccgggcgcggtggtggccagccggtacgtggcgggcagcagcgaggcccgggtcggcggcgactggtacgacgtgatcgccgacccggacggcgggctgtgcctggtgatcggcgacgtggtcggcaagggcgtgcaggccgcggccgcgatgggccagctgcggaacgcgctgcgggcgtacctgctggagggtttcgactgcggcgccgcactgagccggctcaaccggctggtggacacgctcggccggcggcagttcgccacggtgttctgcctgcgcttcgacccgatcacccgggtggcccggtattccgcggccggtcatccgtcgccgatccgggtgaccggcggcgaactcggctcgttcctgtaccgcaccgcgctcggcccgccgatcggagcgctgcgcgaggtcgcctacccggcgcacgaggtgcggctggcgctcggcgaccggctgctgctctacaccgacgggctggtcgaggaccggcggcagggcatcgacgccggcctggccgagctgaccgcggatgtggccaggccggccgagcacatcgaggacctgctggacacgctgctggccaaggccgcccggcaggtccgccgggacgacatcgcgctgatcgcgctgcaggtcaccgagccgaccgagttcgtgatgcggctgccggccgacccgacccggctcagtgtgctgcgccagcgcctggaggacttcctgaccgcgcacgcggtgccggacgccgaccagttcgacctgaccgtggcggtctccgaggcggcggcgaacgcgatcgagcacccggtcgagccggccgagccggtgatcaccgtggaggcctcgatgcagccggacgcgatcgtggtgatcgtgcgggacaccggtcagtggcggccggccaccgacgcgggtttccgcgggcgtgggctggccctgatcggcgccctgaccgagctgtccgtgcaccggtcgccggccgggaccgcggtgaccctgcggcggccgctgaccgcggcctgacggtcagtgcgacctgagccagggctggccgcccaggccggagatgtcgagcacccggcgcacccgctcggaggggatcacctcgagcgtttccggataccgctcggcgagccggatcagggtgtggatggcggccgagtcgaagaaggtgaccgcccgcaggtcgatggtggcgccggtgatccgctccggggtggcggtctcgaacagggcgcccgcggtggacatgtcgacctcgccggtcacggtgacgaccacccgatcaccgtcgaccgcgccggtcgccgtgaaagtcgggtcctgcccctcttgatccaccgatacacgatttcacagcgggtcgccgagcggcaaggacgggaccgatggtggctccgaacggcggataggctgtgattcatgaccgtacgtgcaccgctcgtgccgggcaagcagtcgcgtgagcgatcggtcccggccaccatcgtccgccccgaatacgtcggcaagaaacggcccgcgccgtggcacggctcgcacgtgcagaccccggagaccatcgagaggatgcgggtcgccggccggatcgccgcgcaggccacccagctcgccggcgagcactgcaagccgggggtgaccaccgacgagatcgaccgggtggtgcacgagttcatcctcgaccacggggcgtacccgtccaccctgggctacaagggtttccccaagtcctgctgcacctcgctgaacgaggtgatctgccacggcatcccggactccaccgtgctggaggacggcgacatcatcaacgtcgacgtcacggcgtacctgaacggcgtgcacggcgacaccgacgccacgttctgcgtcggagaggtcgatgaggaggcccggctgctggtcgagcgcacccacgaggcgatgatgcgggggatcagggcggtcgcgccgggacggcagatcaacgcgatcgggcgggtgatcgaggcgtacgcgcgccggttcggctacggcgtggtgcgcgacttcaccggtcacgggatcggcgagacgttccactccgggctgtacgtgccgcactacgacaagcccgacctgaccgtcgtgatggagccggggatgaccttcaccatcgagccgatgatcaccctcggcacccatgagtacgagatctgggcggacggctggacggtcgtcaccaaggaccgcaggtggaccgcgcagttcgagcacacgctggtggtgaccgaggacggcgtcgagatcctcaccctgccgtgaccccggtgatcgagcaccaccacgccgacgtctccggcggctggctgcgggccgcgaccttcggcgcgatggacggcctggtgaccaacatcgcgctgatcgccggggtcggcggtgcccaggtgagccggcacgcgctgatcctcaccggggtggccggtctggtcgccggcgcgatctcgatgggcatcggggagtacacgagcgtccgcacccagaacgagcagatcgccgccgagctcggcaaggagctgcacgagctgcgggtcaacccggacggcgaggccgacgagctggtcgcgatgtgggtggcccgcggtctgccggccggcctggcccggcaggtcgccgacgtgctcaagcggaacccggaccaggcgttgcgggtgcatgcccaggaggagctgggcgtggtgccggacgagctgcccagcccgtggacggcggccggctcgtcgttcgtctgtttctcggtgggcgcggtgatcccgctcctcacgctgctgatggggtacgacaacctgtgggccgccctggccgtcggcgggctcggcctgttcgcggcgggcgcggtggtgtcccggctgaccctgcgggcctggtggctcggcggcctgcggcagctcgtgctgggcgcggtggcggccggactgacgtacctcatcgggtcgttgatcggggtctagcgggcaccgctagtcgaagagcgcgcccagggtgccgtccaccgggcggccccgggcggccagctcctcggcctggtatttgaggatcgccccgagctcctgcatgtcggcggcggccaccccggtgcgccgcaccgcgtccgcggcgttgcggaaccaggtgtgggtgaggaagccggcgaccagcgcggcgttcacccgggcctgggcgatcagcaccaacgcggcgtcggtgtcgtaccactgggtgagccggaccgcccgctgccgtgccccgttcgcgatcgcccagttgtgccgggccagctgggcgtactccgccgggcgggcctcggcaagcaggttctggtgcgcctcgcgcagctcccggaaacacccgcgcgggtcgtgcagcggcatcgtggtcaggtaccggtcggccagcagcggccagcgcggggtcagctgccgggcctgggcgatcgcctcgtcggcggcgagcaccgccaggtcgaccggcacgccgtcgaccttgcgcagcgccggccgcggcccggtccgcgggcgataggtcaccacgatcaggttgacgtcgctggtctcggtgtcgtccgcgtgggccaccgagccgcgcacgccgatcgccagcacctcggccggccaacgacgttggatcgcgtcgcagagccggagggcgagcgaaccgcggggcgaggtggtgtcgatctcgtcgagcaccaccccattctggtcgttcaggcgcccgggcgacccggaaagatcagggtcagcggggtgacctgggcgaacttgcgccaccgggtggcacggatcgccgaggcggtcaaagcggacagcgcggtggtgcgctgggtgttctcggtcaccggcagtaccgggcgccaggcctgggcgaccccgtcctcgatctggacggccagtttcagcgcggcggcccggtcggtgaccgggaacggcagctgatagcccgccggggtcggcgcggcgccggcctgcaacccggccagctgctcgaccaggtcgtcgcggcgcacccggtgctcctgctcggcggcccgggcctggtcctgctcggcgccgggcggcaggtgcacgccgatcaccccgtacgcccagatcgccgcctgctcggcggcgagcgcggcggccagttcatctttcacgttcgagaaactagcgcagagcctcggcgtgggtggctcgcgcggcggcgatcgagccgatcagcgccgcccggccggccggggcgctctggcacgcggcgaccgcggtcttctgcgcggcgagttccgccctgcgcaggccggccacggtgccgtcgacgatggacgcgcccggggcggcgccgggcgcggtgaccccgatcacccgggccagctcggcggcgtgcgcccggtgcgcctgggcgatcggggtgagcgtggcgctcagcgactgctgggccaggatcacccggtcgtacgtcgcggccagggtgaccgcctcgtccagcaccggctgcagcgggtccggccccttcggcggctcggggtcgtcaccgaacagaccgcaaccgctgagcgtgaccgtcccggccagaacgccgcccgcggcgagcacccgccgccgggtgggatccgcatcacctatccgcaccggatcagtcaacaccatcgccttcgcgggtgaagtcccgggccgctgacctgcggttcacgtgtttccggtgcggcgctgcgccgcccgcgcgccgggcgcgttaggctctgcgtcagccgcggggccaccgactgcccggcggcatatagtcgttgcagcgtaaattcgcgctgatgcagcgtgaacgcgagtgagaggtcgagcccgatgacgcagcgtggtcgcgccggggcccggcccggcggccgcccgagcagccgctcggattcccggagtgcccccgccctgccgcgcgtcgacctgaccgcggctcgcgcccggctgcgcgaggtggtcgagccggtggtcgccaaggcgggctacgacctggaggacctgaccgtgtcccgggccgggcgccggttcgtggtccgggtgctgatcgacgccgacggcgggatcggcctggacgatgtggcggtcgtctcccgggagatctccgaggccctggatgccgcggatgagcggggcggcgaggtcctggcgggggagtatcaactggaggtcggctcgcccggggtggaccggccgctgaccgagccccggcactggcggcgcaacgccggccggctggtcgccgtcaacgggctgaccggccgggtgctgagcaccgacgacgacggcgtgaccctcgacgtggacggcgccgagcgcagggtggcctgggccgacctgggtgcgggcaaggtccagatcgagttcaagcgcctggacgaggccgagttcggcgacgaggacgacgccgacgacgaagatgaagacgaaggggagggcgaggagtgaacatcgacctcgcggcgctgcgcgccctggagcgcgagcgggagatcccgttcgagacgatcctcgcggcgatcgagaccgcgctgctgaccgcgtaccggcacaccgagggcgcggagagccacgcccgggtggagatcgaccgcaggtccggcgtcgcctcggtgctggcgcaggagaccgacgcggacggcacggtggtccgggagtgggacgacaccccgcacgacttcggccggatcgccgcgatgaccgccaagcaggtgatcctgcagcggctccgggaggccaccgacgagcagcacttcggtgagtacgcggggcgcgacggcgacctggtcaccggcgtggtgcaggccgacgcggcgcgtgccgagaagggcatcgtgatcgtcgatctgggcaagctggaggcggtgctgccgcagtccgagcaggtccccggcgagtcctacgagcacggatcccggatccgctgcatcgtggtgcacgtggccaagggcttccgcggcccgcagatcaccctgtcccgctcgcaccccgccctggtgaagaagttgttcgccctcgaggtgccggagatcgcggacgggaccgtggagatcgccgcgatcgcgcgtgagtccggtcaccgtacgaagatcgcggtccggtccaccgtccagggtgtgaacgccaagggcgcctgcatcggtccgatgggccagcgggtccgcgcggtgatgagcgagctgcacggtgagaagatcgacatcatcgactggtccgacgacccggcgcagttcgtcgggaacgcgctgtcgccggccaaggcgctgcgcgtcgaggtggtcgacgcggccacccggacggccagggtgaccgtgcccgatttccagttgtccctggcgatcggccgggagggacagaacgctcggctcgccgcccggctcaccgggtggcgcatcgacatccgtccggacaacgaacccgccacagtcgcggaccgtgatgcggccgaggcggggaactgaccggatacgcggtcgccgcgatcgaggggtagacttgtcctcggtcggcccgacgcgaacctgcgtcggttgccgtaaacgcgcgccggccgcttcattgctgcggttcgtcgcggtcggatccggggaagacctccggcttctgcccgatccaagccgccgactgccgggccggggagcgcacctgcatcccgatccggcctgcttcgagcaggcggagcgacgtcgagccttcgggcgggcgttgcgactcaccggtgttgctgatgccggattgcttgccgagcacatccgcacggtctccgtgccgtgcggaaccaccgatgacgaggcgttctcgccccgtcacgacccagcaaggtaggacgacccagatgagcactcgatgaagtccctgaaatgaccaggcttctagtgcacgagtgaggtcgttgcgggtactgctcgcacgacctcgagatgaggagtgcagtgccaggcaaggcccgcgttcacgagctcgccaaagagctcggggtcgacagcaagaccgttctcgccaccctgaaggacatgggcgagttcgttaagtccgcatcgagcaccgtcgaggccccggtggcccggcggctccgtggcgccctcgaggcgggcggcgcgctcccctagctagctagcgccggcggcggtttccgtcccggtggcggtggccccggtggcggtggcggcggcccggtcggcgcgggtgctccgggtcgtcccggtggcgccggtggccgtggtcgtggcggtggcgcggcgggtgccttcgggcgtcccggcggccggccgacgcgtggccggaagtcgaagaagcagcggcgtcaggagttcgacaacctgtcggctccgcagatgagctcgggtgctccgcgcggtcagggtcaggagatccggctgtcgcgtggcgcctcgctgtccgacttcgccgacaagatcaacgcgaacccgggctcgctcgtccaggagatgttcaacctgggcgagatggtcacggcgacgcagtcggtctccgacgacacgctgctgctgctcggtgagcacctcggcttcgacgtcaagatcgtcagccccgaggacgaggaccgtgagctgctcgcgcagttcaacatcaacctcgacgccgaggtggcggaggaccgtctggtcacccgtcccccggtggtgacggtgatgggtcacgtcgaccacggtaagacgaagctgctcgacgcgatccgcaagaccaacgtggtcgccggcgaggcgggtggcatcacccagcacatcggcgcctaccaggtcgtcgtcccccaccagggggaggagcgggcgatcaccttcatcgacaccccgggtcacgaggcgttcaccgccatgcgtgcccgtggtgcccaggtcaccgacatcgtcatcctcgtggtggcggcggacgacggcgtgatgccgcagacggtcgaggcgctcaaccacgccaaggccgccgaggtgccgatcgtggtcgcggtgaacaaggtcgacaagccggacgccaacccggacaaggtccggcagcagctgaccgactacggcctgctcgccgaggagtacggcggcgacacgatgttcgtcaacgtcgcggccaagcccggcatcggcatcgacgacctgctcgaggcgatcctgctgaccgccgacgcgtcgctggagctgaccgctccgatcgacgggccggcgcagggtgtcgcggtcgaggcgcacctggacaagggccgcggcgccgtcgcgaccgtcctggtgcagaagggcacgctgcgggccggcgactcgatcgtggcgggtggcgcgcacggccgcgtccgcgccatgctcgacgagaacggtcagcaggtcgccgaggccggtccggcccgtccggtgctggtcctgggtctgacgtcggtgcccagcgccggcgacacgttcctggccgccgaggacgaccgcacggtccggcagatcgccgagcagcggcaggctcgccgccgcgcggccgccttcgccaactccggcgccaaggccacgctcgagacgctcatggctcagctcaaggagggcgagaagacctcgctcacgctggtcatcaagggcgacagctcgggctcggtcgaggctctcgaggacgcgctgttcaagatcgagattccggacgagattcagctcaaggtcatccaccgcggcgtcggtgcgatcaccgagagcgacgtcaacctggcgtcggcctcgtcggagcagaccgcgacgatcatcggcttcaatgtccgggcctccaacaaggtcaaggagatggccgaccgcgccggcgtggagatccgctactacagcgtgatctaccaggccatcgaggagatcgaggcggcgctcaagggcctgctcaaaccggagtacgaagaggtcgagctgggcacggcggagatccgcgaggtcttccgttcgtccaagatcggtctgatcgccggctgtctggtccggtccgggctcctccgccgcaacgccaaggcgcgtatcctgcgcgacggcaccgtggtgggcgagaacgtcacgatcagctcgctcaagcggttcaaggacgacgcgaccgaggtccgcgagggcttcgagtgtggtctgaccctgcagggcttcggcacgccgcagatcggcgacgtgatcgagacctacgagatgcgggagaagccgcgggcctgatccccggctgaggtttccccgacggtcccggtgcgctgcgcaccgggaccgtcgctttgccggtacgccgagggccgccccttgtcctccggcgccacccgggctgggagaatcggggcatgtcccgttacgccatgctgctcgccccgtccgccaaccgcgtctacgccgaccaggcgtcccgcatgtcccaggcggagctggccgcgttcaccccggtgctgtccagtgcgccggcggagatcggggtgaccggcatcggcggggtggagtacgtgacgttcaccgccgagctgaccccgcgggacgtcgcccacctgtccaacctctcctcggcgtacgcgctgttcgagctggtcggcgacgacctgctgcggccggtcacgctgaccccgctggcccggtacgacagcgacctgatcaccatcccgaaatacgccgggaagaccaacgagcagttcaccaagctggtgctgaacctcacgctgctcgcctccgcctccgcgaccaagatgctggacgggcacctcaccgtgctggacccgctgtgcggccgcggcaccacgctcaaccaggcgctgatgtacggatacgacgcgatcggcgtggagatcgacggcaaggacgtcgaggcgtacaagctgttcctgcagacctggctcaagcgcaagcggctcaagcacaccgccgacctggtgccgatgcgccggcagggccgccgggccgcgcgccggctggaggtcacgatggcggccagcagggacgaccacaaggccggcgcggtgcagaaactgaccgtgctgcacgccgacaccaccgcgctggacgggctgatccggggcaacgtggccgacgtgctggtggccgacctgccctacggggtggcgcacgggtcgtacgacgacgccggcggcatctcccgccgcccgctggacctgctggagcgcgccgtgccggagtggctgccgctgctgcgtgccggtggcgcggtcggcctgtcctggaacaccaaggtggccaagcgggagctcgccgaggacatcctgaccgccgccgggctggagatcgtcgagcacgctgatctggcgcaccgggtcgatcagggcatcgagcgcgacgtgctgatcgcccgccggcgctgaccggggaaaaggggctgaccagcagcgcgatggggcgtagcctggctcgctgatgtataccgagaccgcagtcttcgacatgctcctgcccggtgacgcgcaatcgctgaagcagaagcgcagctacgtccgcccgatcatcgcgatgctcaagaaattcgaggtcagcgtcgccgaggtgggcttccacgacctgcacggccgggcccagatcggggtggccgtggtcgcccccgacccggcgcaggcgcgcgccgtcatcgacacctgcgagcaccaggtggccggccggccggagatcgagctcctatcggtcaaacgtcgcctctacggtgacgacgactgaaaaccgcatggtgggcgggcggccccacctgggtacgcttcagcagttgggcgggggcaacggtgacccgcggtgttacacagtcggaggtgggcgagatgtcggatccggccaagacgcggcggcacgcggagcgtgttcgtgagctggtggcctcactggtgcgggagatcaaggatccccgtctcggcatggtgacggtcacggacgcccggatcaccggtgacctccgggaggcgaccgttttctacaccgtgctcggcgacgtcaccgagcaggccgccacggcggccgcgctggagagtgccaagggcatgctgcgcagccgggtcgggcatgcgctggggctgcggcactcgccgagcctggcgttcaagctcgacaacgtgcaggacaacgtgaaggagatcgacgacctgctggccgcggcccggcaccgcgacgaggaggtgcagcggctggcggccggcaagaagtatgccggcgaccccgacccgtacaaggccgacgagccggccgaggacgacgaggacgagaccgagcgggtgggtgcccgcgaggacctcgggtgacgctgccgtcagggcccgccgccgagcagtgggaggccgcggtcgccgcggtccgtgcgctcggcggcgacgcggcgatccagttgatctgccacgtgagcccggacggggacgcgctcggcagcatgctcgggttcgcgctggcgctgcgccggctcgggcacacccgggtccgggccaccttcccgggcgagttccgggtgcccacgccgtacacccggttgccgggcatcgagatgctggtgccggagccggaggcctaccatgacccggagctcttcctggtcttcgacgtggccgccgagtcgcggctgggcggcctggccgcccgggtcgcggcggcgccggtcagcgtggtcctcgaccaccacgcgtcgaacccgggattcggcacgatccgcctgatcgacccgtgcgcggcggccacctcggtgctcgccgaggagctggtcacccggctcggggtgccgctggacgcggagatcgccgagtgcttctacgtggcgctggccaccgacaccgggtcgttcaggttcgaggcgaccacggtggcggtgcacgagctggccgcccggctgatcgcgaccggcctgcgccccggcgagatctcccggcggatcttcgacacccggccgttcggtgccgtgaaactggccggtgaggtgctcggacgggcggtgctggaaccgtccgcggccggcgggcgggggctcgtctggacctacgccacgctggccgacctggaccggcacgaacaaccgccatacgtgctcgacacgttgatcgacccggtccggtcggtggccgaggccgacgtgacgctgctggtgaaacaggtggcggagaatgagtgggcggtgtcgctgcgcagcaagggcgcggtcgacgtgagccgtctggcgatctcccagggtggcggcggtcaccgcctggccgccggtttcaccggttatggggggcctggtgacgtggtggacaccgtgcgtcggctacttgacgaatttctggattgacgctgttcgtccagctcatagggggtcacccgaaggggtggcccctttcttttcgtctcggatcccgggatcccgccgtggtgtggctgactgaacgttagtttgagtgctgaacggtgatttggttttgcgcggctgacacctccgcctcccgcgagaccgcgagccgcccgtggccaccgccccgggtcgcgtcaccccgccaggagtccggcgaccccggaccggcccatgtgacgccccgctcgaccgcttccgggcgcacgtcgtgcgcccccaccacgccgtggaaggaaacactccgatggctgccaagcccaagccccagccctccgaagacgcccgtgagcaggcccgcagggccctgcagacctcgctcgacacgcgccagtaggggttcgtcgggccactaggggtaaggttcaataccctgttgtaggccttaccgccgggcgggcatcatgggtaaccatgagcccgcctgcccagcaccgcaccggttcccgccagatcgccagcctcgccctgccggcgctcgtggtgctggccgccgaaccgctgtacgtgctggtcgacacggccgtcgtcggccacctgggacgcgcgccgctcagcgccgtcgccgtcggcggcaccgtgatgtcggtcgccgtctggttcggcaccctgatggcgtacgggacgaccggccgcgccgcccgccgcttcggcgccggcgaccgccccgccgccgtcgccgaaggggtccaggcctcctggatggccctcggcttcggcctcgtgctcagcatcctcggggtgaccctggccgggccggtcacccacgccctggccggcaatccggccaccgccgacgctgcggccggctggctgcggatcgccgccctcggcgttcccgggctgctgctcgccgccgccggcaacggatggatgcgcggcgtccaggacacccgacggccactgatcatcgtgctcggggcgaacgtgctctccgccgtcctctgtccactgctggtgttcccgctcggcctcggcctgaccggatcggcgatcgccaacgtcaccgcgcagtcggtcgggggtggactgttcctgctcgccctgatccgcgagacccggcacctgcggcccatcccggcggtgatcatcaagcaggtggtgctcgggcgggacctgctcatccgcggagccgccttccaggcctgcttcctgtccgcgaccgcggtcgcctcccgattcggggtcgccgcggtcggggcgcaccagatcgcgttgcaactctggttcttcgccgccctcgccctggacgcggtcgccatcgccgcgcagtcactggtcggggcggcactcggcgccggcgacgcggaccaggcccgggacatcgcgcggcgggtcaccatcgccggaggcatcgcggccgtcgggttcgccgtcctggcgggcgccggatcgtcggtgatccccggatggttcacccgggacccgtcggtgctctcccaggccgcaatcgtgtggccctggttcgtggcgctgctgccgttcgccggcatcgtgtacgcgttggacggcgtgctgatcggcgccggggatgtggcctacctgcggctgacgacgatgctggcggcgctgctgggcttcctgccgatgatctggctggcgtatgcgttcgacctcgggctcgggggagtgtgggcggggctcgggctgttcatcgtggcccggctgatcgccacggtttcgcggtggcggtcgtcgcgctgggcggtcatcggcgcgacccgctgatctgcggcggcgcgcatccggtggcgccccgatgtggtcgctcgccgggcggcggggtcttcgctcgctgtcgcggccgccgctcggagctcccggagaatagacgaatccgctggttgtggccttggttcagggagtcgctaaagtgttccggtggatggattgatcgtggtggacaagccctcggggatgacgtcgcatgacgtggtggcgcggattcggcggctggccaagacccgacgggtcgggcatgggggcacgctcgatccgatggcgaccggtgtgctgatcatcggggtgaatcgggcgacccgcctgctgacctatgtgatcggtgcggagaagagctacgccgcgacgatccggctgggggaggcgacggtcaccgatgacgccgagggcgaggtgaccgcgaccgtcccggtggccggcgtggcggatgcggcgatccgcgccgggctggccgcgcaggtcggggagatcgatcaggtgccgagtgcggtcagcgctatcaagatcaatggcgagcgggcctacaagcgggtgcgggacggcgagaccgtggcgattccggctcgccgggtgaccgtgttccggctcgacgtgctggacatccggcggccggccgatcgggacgtgatcgacgtggacgtcgacgtgacctgctcgtcggggacgtacatccgggcgatcgcgcgggacctcgggacggcgctcggggtgggcgggcatctgacggcgctgcggcggaccgcggtgggcgcgatgacgctggcggccgcttcgacgctggaggagctggcggagcgggcgccggacgtggtggggctgccgatggcggaggcggcgcggcgggcgttcccgcagcgggtcgccgacgaggaggagacccggacgctgcggcacggtgggccgctggcggcggtggggatcgaggggccgtacgcggtgttcgacgccgacggcgaggtgctggcgatcgtgagtgagcggggcgggcgggcgcgggccgagatcgtgctctccccggcctagagccggagattccgggcgacggtggcgaccaggtcggcggcggcgtagggcttgtcgaggaagtcgtcgcagccggcgtccagggcggccttctggtcctggggcaggacgctggcggtgaccgcgaccaccaccggcttggggcggtccgcgggcggtgcgctcttcagctcgcgggccagggtcaggccgttgccgtcgggcaggttcaggtccagcaggatcaggtccagctcggtgtcgtggacccgggcgcgggcctcggtgagggtggtggcgtcgaccagttcagcgtcgcggaccgcgtccacgccggcccgggagaggaccgctttgaccagcatccggttcaactcctcgtcctcgaccaacaggatgcggtgactcatcgccggtccttccctgatgacggtacggcgctgcgcagcgggaccgcgccggccggtgggtgggcgccgccggcggtgcggcgagccgccgggtgggccgggaccgccgggtggatcgaggccgggtggtgcgggatcgccgggtgtgcggtgcccgggtggtggccgagcagcggggccaggctgtcccagccggcgccgccggccatcgcctcggcgaccaccccgccggccatcgcggtggcgatcagcggggcggtgtcgccgggggcccgctcggccagggcggccgcgctcagaccgaggaccggggtgtgccggccggacgggtcctgctcgatcgcggcgagcaggctgaagccgtccgcggacggggactgcatgtcgcagacgatcaggtcgaagttctcggcgcggctgcgggccagcccgtcccggccgtcggcgcaggagaccacgtcggcgccgccggcccgcagaccgtcctcgatcgcctggcggaccgcgtcgtcgtggtcgacgaccagcacccgtggggccgggcgggcggcgatcgcgttggccagcgcgttgagcagggccggctggtcgaccggcttgatgaagtagtcgtgcgcgccgagggccaggccggccgcggcctcgtccaggatgctggcgaagaagaccggcacgacggcgagcgcggcgtccgccttcagccggcggatcacctcccagccggagatgccgggcagttcgacgtcgagcacgatcgcgtccggcttgtgggcgcgggcgacggccaggccgctctccccggtgccggccacctccacccggtagccggcgttgctcagctgggtctgcatcagctcggccgagtgcgggtcgtcctcgatgagcagcacacacggggcgttcgccgcaccggtggcgctgggccgggtgaccggggcggcgggcagccgcaccgtgaacgagctgccctgcccgggcgtcgagctgagggtgatctcgccacgctgcgcctcgaccagccggcgggtcagtgccagacccaggccggtcccggcctgccgccgctccgggtcgccgacctgctggaactcctcgaagacgcgttccgcgtcggtgtccgcgatgcccaccccggtgtccgccacggtgatcgtgacctgttccccggactcccccgtggtgatcgtcaccattccctcggccggggtgaacttgatcgcgttggagaagaggttctccaggatctgccgcagccgcagccggtcggccagcgcggtcaccggggcgagctcggtcatcacggtcaggcgtttgtcggcgaacagcggggacaggccggtgagcagctcctcgatcgcggtgtccacccggaccggggcgacccgcaggtccatccggccggcctccaccttggccaggtcgaggatgtcgttgatcaggccgagcaggtgccggccgctgccgtggatgtggtcgacccagtcggccggcacccggcggcggtcaccctccggctcctccagccgcatcaggtcgctgaagccgatgatcgcgttcagcggggtccgcagctcgtggctcatgttcgccaggaagttgctcttcgcctcgttggcccgggtcagggcctccaccgagttggtcagctcggcggtcagccggcgttcccgcacggtcaccgcggaccgttcggcgagcagcccggcgtgcccgccgagctcggcgagcaggcccaggtcgtcgtcgttgaacagcccgcggtaccggttgaacagcagcacccagccctcgatgtcgggcggcaccggcatccgcagcgcggtgacgaagtcgtcggccaggccggcaccgaaatgtcggagcagggccgggtcgccgtcgcgcagcgggcccggccggcccagggcggcgcggatcggctcgtcggggacgtccagcggcggaccggcgtagccgatctgccacagctgaccgtccggccggggcagcagcacggcgaccgcgtcggccccggtctgcacccgcatgatctcggcgtaggtctgccagaccgcctccggggactcggccggggcgcgcagcagccgctcggtgaccgagtgcgcggccgcggccgcgaacagcccgcgcagccacgcgggcggggcgaaggcgatcaggtagcccagtccgctgatcagggccagcacgtggctggcggtgcggacgccggacacgtggccgccggaggcgccgagcagcatgatcatcacgccgaaggcggtggtggcggccgcggcgatggtcagccgggcccggttggcgccggtccggcagcgggccgtgtcgtacagcagggcggccgcgatgaactcgacggacaaaaaataggtcgacgccgccaccttgagcgggaccgggaccgggcggtgggcgaccgccagcggtccggccagcgccaggaagccgagcagggccgcggtggtcagtgccggcggcacccggcgcagccgtccggccagccgcagggtgagcaccggctgggccatcagggcgaccgccgtgaacccgccggccagggccggccgggtggccaggctctggcgcagcaggtcggcgcagaaggccagggtgcacggcgcgaagacgagagccacgtcgcggcgcagcgggtcgcggtggcgcaggtatccgccgagcgcgcgcaggaagaggaccgcgaaggtgagctccgcggcgagcaggacaagacggctccactcgacgctcatatcggtgctaatcgtaccgatccgggcgcgtcgcagggtggattagcgatcgatacgctatggctgacgacgaggcggaggagctttctcgatgcagcggtggcggggattggagtcggtgcccggtggctggggccgatcggtcgtgaccatcggcgtcttcgacggtgtgcaccgtggccaccaggcgatcatcgggcacgcggtgaagcgcgcccgcgacatgggtctgcagtcggtggtgatgaccttcgacccgcacccgtccgaggtggtccgccccggctcgcacccggcggtgctgaccgagtcggtgcgcaaggccgagctgatcgagcggctcggcgtggacgcgctctgcgtggtcccgttcacccgggagttctcccagctgggtccggacgcgttcgtgcacgacgtgctggtcggggcgctgcacgcggcggacgtggtggtcggcgacaacttccgcttcgggcaccgggccgccggggacgtggcgctgctggagagcctggggcgcaccttcggcttcaccgtcgaggaggcgccgctggtctcggcggacggcgtggtgttctcgtcgacgtacatccgcagttgtgtcgacgcaggtgacgtgcgcgccgcggcggcggcgctgggccggccgcaccgcctggccggcgtggtcgtccggggcgaccagcgagggcgggagctcggcttccccacggcgaacctgatgacgcaccgctatgcggcggtgccggccgacggggtctacgccgcgtggctgacccgggccggggagaatgccggccgatggcccgccagtgtttcgatcggcaccaatcccaccttcgaggggcgggaacgccgggtggaggcgtatgcgctcggtttctcgggtgatctgtacggcgaaagggtcagcctcgatttcgtcgagcacttgcgtgagcagcggaaatacgacgccatcgaaccattggtcgcgcagatccgggccgacgtggaagagacccgggtgttgctgcgttaaccccctggtagggtttgagtgtcgtctgaattattcgacaccggtcccgctgtgctcttgaagagcaggcctgcccgacgccgcgggctgcggggacaccgtgaatcggcaacacagaagtacggagatcatggcgctcgatcaagacaccaagaacaagatcatgacggagtacgcgaccaaggagggcgacaccggttcgcccgaggttcaggtcgccatgctcaccaagcggatcgccgacctgaccgagcacctcaagctgcacaagcacgaccaccacagccgtcgtggtctgctgctgctcgtcggccagcgccgccgcctgctgaactacgttcagaagaaggacatcgcccgctaccggacgctcatcgagcgcctcggcctgcgtcgataagtttccctcagggagcggccccggccgctccctgacgtaacaccaccccacggacccgcgcggctcacaccggcagcaccggtctccggtagtggttcccaggctcactcctgggtacttcgatcgaagaccggcctcgttgaaacgcgctgtagaccgccgggtcctcgacgaagaggagtacctcacttgacagagcagaccgctctcggcactgaatctcgcacggcagtcatcgacaacgggtcgttcggcacccgcgagatcgtcttctccaccggccggctggccaagcaggccgccggctcggtgatcgtccagctgggcgacaccaccgttctctccgcgaccaccgcgagcaaggcgccgaaggagcacttcgacttcttcccgctgaccgtcgacgtcgaggagcggatgtacgccgcgggccggatccccggctcgttcttccggcgcgagggtcgtcccagcgaggacgccatcctcacctgccggctgatcgaccggccgctgcgcccgtcgttcaccaagggcctgcgcaacgaggttcaggtcgtcgagaccatcctcgcgctcgacccgtcccacccgtacgacgtggtcgcgatgaacgccgcgtcgatgtccaccaagctctccggcctgccgttcagcggcccggtcggctccacccgggtcgcgcacatcgacggccagtgggtcgccttcccgaccatcgaggagctggagcgcgccaccttcgacatggtggtcgccggtcgtgtgaccgccgagggtgacgtcgcgatcatgatggtcgaggccgaggccaccccgcaggcggtcaagctgatcgccgccggcgccaccgcgccgaccgaggaggtcgtggccagcggtctggaggccgccaagcccgcgatccgcgagctgtgccgcgcgcagagcgagctggccgacgtcgccgccaagccggtcgccgagttcccggtcttcctggactaccaggatgatgtgtacgccgcggtcagcgacgcggtgcgcggcgagaccgccgaggccctgaagatcgccgcgaagcaggagcgcgaggaagccctcgacctggtcaaggcgaaggcgcacgagctgctcgacgagcggttcgagggccgggagaaggagatcagcgcggcgttccgctcggtcaccaaggccgaggtgcggcagcgggtgctgcgcgagcaggtccgcatcgacggccgtggcccgcgtgacatccgtccgctgaccgcgcagatcggtgtgctgccccgggtgcacggctcggcgctgttcgagcgcggcgagacccagatcctgggtgtcaccacgctgaacatgctgcgcatggagcaggcgctggacactctcgcccccgagaagaccaagcgctacatgcacaactacaacttcccgccgtactcgaccggtgagaccggccgggtcggctcgccgaagcgccgcgagatcggtcacggcgcgctggccgagcgggcgctggtcccggtcctgccgtcgcgcgaggagttcccctacgcgatccgtcaggtgtccgaggcgctcggctccaacggttccacctcgatgggctcggtctgcgcctcgacgctggccctgctcgccgccggtgtgccgctgaaggcgccggtcgccggcatcgcgatgggcctgatctccgacgaggtcgacggcaagacccagtacatcgcgctgaccgacatcctcggcgccgaggacgcgttcggcgacatggacttcaaggtcgccggcaccagcgagttcgtcaccgccctgcagctggacaccaagctcgacggcatcccgtcggacgtgctggccggcgcgctgcagcaggcgcacgaggcgcgggccacgattctcggcgtgatgaacgccgcgatcgagtccccggccgcgatgagcgagcacgccccgcgggtcaccaccgtgaagatcccggtcgacaagatcggcatggtgatcggcccgaagggtcagaccatcaacgcgatccaggacgagaccggcgccgacatctccatcgaggacgacggcacgatctacgtcggtgcgaccaacggcccggccgccgaggccgccgtcgagcggatcaacgcgatcgccaacccgaccctgccgaagatgggcgacaagttcctgggcacggtggtgaagacggccgcgttcggcgcgttcatctcgctgctgcccggccgcgacggcctgctgcacatctcgaaggtgggcgacggcaagcgggtcgacaaggtcgaggacttcctcaacgtcggcgaccgggtcgaggtccagatcgcggacatcgacgcccggggcaagatctacctggacaaggtgcgcccggagggcgaggaggccccggctgcggctgcggctgcggctgcggacgccccgtcgtccgagggtcgcccggagcgggccccgcgggagaaccgcgagggtggcggcgagccccgccgtcgccgctcccggccggccggcgagcgccgcgactaagcagtgacgtccagcgaccgcgggccggccggcaggccggcccgcgtttctaccaggaccctgcaggacggcgtgaagaagaccgtcctgccgagcggcctgcgcgtgatcaccgaggcgatcccgaccacccgcagcgccgccctcggcgtctgggtcgggatcggctcccgggacgagacgccggccatgtccggcgcctcgcacttcctggagcacctgctcttcaagggcacccacaagcgcaccgcgctgcagatctccgcggagatcgaggcggtgggcggcgagaccaacgcgttcaccaccaaggagtacacctgctattacgcgcgggtgctcgacaccgacctgccgctcgcggtggacgtgctggtggacgcggtggccgactcgatcctcgacccggccgacgtggagaccgaacgtggcgtgatcctcgaggagatcgccatgcacgaggacgagcccggtgatgaggtgcacgacgtcttcaccgaggcgatctacggcacccacccgctgggccggttgatctccggcaccccggagtcggtcaccccgatgacccggaaccagatcaacagcttctaccgcaagcggtaccgggcgccggagatcgtggtcgcggcggccggcaacctcgaccacgccaccgtggtccggctggtgcgcaaggcgctggccggcagcccgctggacaccggcccggccgagccggccccgccccgccccgacggcacccgggtccgcgtgcagaaaccgcacaccgtggtggtgcaccgggacaccgagcaggcgcacatcgtgctcggcgcgcccggcctgagccggtacgacgaccgccgcttcgccctgggcgtgctcaacaacgtgctgggcggcggcatgtcgagccggctgttccaggagatccgggagaagcgtggcctggcctactcggtgtattcctacgccagccagtacgccgacaccggtgtcttcggcgtctacgccggctgcgcgcccggcaaggcccccgaagtcctcgacctgatccgcaccgagctcgcccgggtggcggccggcgggatcaccgccgaggaactcgtgcgcggcaagggcatggtgaagggctcgtacgtgctgggcttggaggacaccggctcccggatgagccggctcgccaagtccgagctgctgcacggcgacctgatgggcgtcgacgacctgctcgcgcgggtcgacggggtgagcatcgccgacgtcggcgaggtggccggggccctgctgtcccgggaacactcgctggccgtggtgggcccgttcgacgagggcgacttcccgcccggctgaccggcctgccggtacgttaggttgacgctgtgactgacgtgctcgaacccatccgtgtcggtgttctcggcgcccggggccgcatgggcctcgaggtgtgcaaggccgtcgacggcgcccccgacctcgacctggtggcgctcgtcgaccacgacgacacgctgcaggcggccgccgaggccggcgctcaggtgctggtcgacttcaccaacccgggcgtcgtcatggacaacctgcgctgggccgtcgagcagggcatccacgtcgtggtcggcacctccggcttcaccgaggagcggctcgcgcaggtccgcggctggctcgccggcaggccggaggtgggcgtcgtgatcgcccccaacttcggcatcggcgcgatcctgatgatgcagttcgcggcccgcgccgcccgctacttcgactcggtggagatcatcgagcagcaccacccgcgcaagctcgacgcgcccagcggcaccgcgacacacaccgcccggctgatcgccgaggcgcgcaaggcggcgaactgcccgccgatgccggacgcgaccgaggacgaggtggacggcgcgcgcggggcggacatcgacggggtgcggatccactcggtgcgggcggccgggctggtggcgcatcaggaggtgctcttcgggcaggccggggagacgctgaccatccggcacgattcgttggaccgctcgtcgttcatgccgggggtgctgctcgcggtccgcgcggtcgtcgaccggccgggcctgacgctgggtctcgacgagctggtttcctgattctgccgatcacgatcatcatgtcgcacgccgcgaccgacaactgatcgctgccccgccgcttccggtcacggcgcttcggggcgcgtgaaacgccgccggtgacgaggcgaccgatctcctgacgcccgcggggtttgccggtggcgggaaaatgggtcgcctcggcaccggctaccaggcgttttgccgcggagcgaagcgggccagccagttcagcgccccgggacggaatcgccgcaccgtactgccggtgggcggtcaccgcaggcgggaccacccctggcgaggacgacacgtgcagcccaccgcgacgcgggtgggcgggcggcaaccggtcacaaaatctggtctttggagactagacattctcgcggaggccggttattgtttctctcgttggtaacgaagatcggttgaagacgccgacgtgacaggccgagcgtcgaagcagggcccggagttctcgtggctcgctcggtaactgcggtggagtcacatcaccgcatgcaagagggcacgtgcaggacaagaccttgacgtaattccaggtcacggcaaccgcaggcggggccggtgcaaggttcagggctcagcctgatgcagcagggatccaccgcacatgtccggggccatgaagtcgcgtggggctccggcatcggaggacagcactgtagatgttggtaagtagaggaaagggagggtttgacgccgttggatcgcccgccatcaggacgtgttttccgttctggggtggacaccgtggtcactttgaacgtgaggtggtctcaggtcacgcttatgcgatcctcgcaccgcctgctgatagcggcggggtgcggaaaagagaacccgatgaacctgtcggtggatggtgtattgaacccgtaaccctgggccccggcgcgttctgcgccggggccctcattcatgaagaaggaatgtatggcccaacccgacgacatgctcaacgacgacgattaccccgcctacaccatgggccgcgccgccgacatcgtcggcgcctcgcaggacttcctgcgccgcctcgacgaagcgaaactgatcatcccgttccgctccgccggcgggcaccgccgctactcccgccatcagctgcgcctggccgcgcgggcccgggagatggtcgaccggggcaccgctctggaagccgcctgccggatcatcatcctcgaagaccagctcaaggaagcccttcagcatcgccgtgaccacgagcgccgccagcaggccggcgccgcctgatcccacgtcgtacggtccttcgccaccccgggaaggaccgtctgctgccccggaatccgcggatgccgcgccctcgcggcgtccgcagtgcaggagctcacgtgggccggcccgggcctcccgcccgttctgtgctatggtctgggtgttgcagttttgatttccgtaagacgtttccagcgcctgatgggttatctgaaacccgtccaggcgctttttcgttgttgtcgtgtcgatgcggcgcgggcgatcaacgcggcggcgtacggggtccgcacaccgcggtctcctctcagcctgcgaaggagcagacatggctaccggcatcgtgaagtggttcaacgccgacaagggcttcggcttcatcaccccggacggcggcggcgccgacgtcttcgcccacttctcggcgatcgcgacgagcggcttccgcagcctcgacgagaaccagaaggtggagttcgacatcacccagggccagaagggcccgcaggcggagaacatccgcccgctctgatccacagcttttcaccgaacggcggcccgactggttcagcgggccgccgttcggcgtttccgcgagcggtggtcatgcccgtttcccggagcggctaccgccatcggtggccggcgcagcggccggcgctcggtcggcttgctaggtcagcgcgacgtggaggcggagctgggggaccagcatgtcgtcgacgtccagggctcggccggcgccgtcgggggcccagccggcggagtccaggaacttgcgcatggccgtgtcggagtcgtagacccaggcgacggccgagctgaaggcgtcctcgcgccacaggtcgacggccgccgcgagcaggcggctgccgtggccacgccggccccagcggggctcgaccagcaggtcggtgaccgcggcgacggtgtccggcagcggcggctcctccggggcgagggcctgctcgtcggccggcccggccgccgcgaaccccaccacgtgatcgtgctcgccctgctcgaccgcgatcagcacccggtgccggccggtcggcggcgtggtgatcgcctcggtccagacgccggccagcaccgcctcgtcgagctgggcgagcacgtgcgccgggaacatccggcggtaggcgctgcgccacgtgacgagctggatgcgcgcgatctcaccggcgtcctcgggacgcgcgggacggacgaagccgagagccatggcggcagcctacagaggaccgcggtagcgcagcttcggcagttcgatcccggccgcggcccggtgtgtcgcgggcaccccgtcggtggtcatcccggctcgctcgtagaagcgccgggcccgctcgttggcggccagtacccagagccgcacctccgggtagccggcctcggccaggacccggcggctctcgtcgaacagtcgccacccggcgtcggtgccccaggagtccgggtcggcatagatggcatacagctcggcgagcgccggatcctcccggtccggcccgaaactggagaaccccacgatccgaccgtcccgctcggcgaccagggtgtgcacctccggcttcgccgccatcgcccgccggcgctgggcgaagaccgccgggtccagcgcggccagatgctcggcgggcaggagcccggcataactggcccgggtgctccgcacgtgcaccgcggccgccgcctcgatgtcggcatcggtctgcggccggaccgacgtcacggtgctgccggccggagtcgcggggttcgtcgatggcgtcacccgacgaactttgtcacacccctggcctagggtgcttctcgatgaccagtctcgagacgatctccgtcgcccaggcccgccgcatcacgctggccgcgcaggggttcaccgaccccaagccgggtggcgccaccgatctgcgccacctgcgccgggtgctgcgccgcctgcacctgatccagatggactcggtgaacgtgttgcagcgcgcccacttcatgccgctctacagccgtctcgggccctatccggccgatctgctggagcgcgcggcctatcagcggccccgggagctgttcgagttctgggggcacgaggcctcgctgatccgggccgacctgcagccgctgttccgctggcggatggcgcgcgccggggagagtgcgtggggcaccatgcgccggatcgtcgccgagcagcccgacctggtcgcctgggtgctcgacgaggtccgccgccgcggcccgatcacggcgaacgagatcgagcacgacgcgccgcgccgcaaggaccactggggatggaactggtcggtggtcaagcaggcgctggagtggctgttctggagcggccaggtcaccgcggccgagcgcaccacgtcgttcgcccggcgctacgacctgcccgagcgggtgctgccgggggccgtgctggccgcgcccaccccggagccggccgaggcgttccgcgccctggtcgagctctccgcccgggcgctgggcgtcgccgccgagcccgagctgcgcgactacttccggctgcccaccgcggcggctcgcaccgcgctcgccgagctggtcgaggcgggggtgctgcgcccggtcacggtccgcggctggaaaccggtggcctatctgcaccgggacgcgaaactcccgcgccgggtcgacgtggccaccctggtcagcccgttcgacccgctgatctggcagcgggaccggaccgagcggctgttcgacatgacgtaccggatcgagatctatgtcccgaaaccgcagcgtcgctacggctactacgtgctgccgttcctgtccggcgaccggttcgcggcccgtgtcgatctgaaggcgaaccggcaggccggcgtcctggaggtgccggccgcctggctggagccgtccgccgaccgggacgcgaccgccggggcgctggccgccgagctgcgccgcctggccctgtggctgggcctggacgcggtcgcggccccggtcgcgggcgacttcgccgacccgctgaccgcggcgctgaaggagctgtgaccagccgcggcggtgaatccggcgcggtgcgcggtgtagcgtggcgctcatgagcaccgtcctcccgccgtggctggaggcccagccgctgcagggtccgccggtcccgcccggctggccggcatatcgccatgacgccggcccgccgcccgaccggatcacccgcttcttcgaccggctggccgcccgctccccgatgtggctggccccgctcgtggtgctggcctgcatgggcggcgcggtcggctacacgctgctcaccgacccggtgcatgccgaggccggcgcggagcccacgtgtctgctgaaatacacgaccggcttcgtctgcccgggttgcggcgggacccgcgccgcgtggtatctgctgcacgggaacctgccggccgcggcccggcaccacgcgatcttcgtgttcgcggtgcccttcctgctgtacatgtatgtggcctgggccgggcagcggctgttccgctggcggattcggcaactcacggtcagtccggccgtgatgatcacgttcatggcggtctgggtggtctggagcgtgctgcgcaaccttccctgggcgccgttcaccgctttctacgtgtgaccgggccgtccgataggttgtcaggtatgacgcacgacccgcggccgttcggacggctgctgaccgccatggtgaccccgttcaccccggacggctcgctggatctggagggtgcggcccgcctggccgttcacctcgtcgacgagcagcgcaacgacgcgctcgtggtcagcggcaccaccggtgagtccccgaccacgaccgacgcggagaaggacgcgctgctgcgtgccgtggtcgaggcggtcggtgaccgggcccgggtcgtggccggggtgggtaccaacaacaccgcccacacgatcgagctggcgcacgccgcggagaaagccggcgcgcacggcctgctcgtggtcactccgtactacaacaagcccccgcaggccggggtgctgcggcatttcaccgcggtggcggacgcggccgggctgccgatcatggcctacgacatcccgcaccgggccggcacggcgatcgccaccgagaccctggtgcggatggccgagcacgagcggatcgtcgcggtcaaggacgccaagggtgacctgatcgccagctcctgggtgctgagccggaccgatctggccttctattcgggcgacgacgcggccaccctgccgctgctctcgatcggcggggtgggcctggtcggcacctcctcgcacttcaccggcgtgctggcgaaagagatgatcgaggcgtacgagaagggtgacaccgccaccgcgctggcccggcaccgcgcggctctccccctgttcaccggcattttccggtccccggggacgatcctggtgaaggccgggctgaacgcgtccggcctgcccgcgggcccggtccgctcgccgctggtggacgcgagtgacgaggaattgatccaactgcgccaggacgccgccgcggccggcatcgtgctctgacaggaagaggcgaatgagtcacgctcacgtggagctgggtccgccgccgccgctgccggagggcgccctgcgcgtcattccgctcggcggtctcggcgccatcggccgcaacatgacggtgctggagttcgacggcaaactgctggtgatcgactgcggggtgctcttccccgacgtcgagcagccgggtgtcgatctgatcctgcccgacttcggcccgatcctggaccggctcgaggacattcaggcgatcgtgctgacccacggtcacgaggaccacatcggtgcggtcccctacctgctggcccacaagccggacatcccgctggtcggctcggagttcacgctggccctggtcgaggcgaaactggccgagcgccggctggacccgtacacgttgaccgtgcgggagggcggcatcgagcggctcggcccgttcgagtgcgagttcttcgcggtcaaccactccatcccggacgcgctggcggtggccgtgcgcacccccgccggcctgctgctgcacaccggcgatttcaagatggaccaggtgccgctggacggccggatcaccgacctggccgggttcgcccggctcggcggcgagggcatcgacctgctgctctccgactcgacgaacgccgaggtgcccggtttcgtggcgccggagcgggacatcggcccggtgctgagccggatcttcggcaaggccaagggccggatcatcgtggccagcttcgcctcccacgtgcaccgcgtccagcaggtgatggacgcggcctgggagtacgaccgcaaggtcgcgctgatcggccgctcgatggtccgcaacatgggcatcgcccgggacctgggcctgctgcgcatcccggacggcctgctggtcggtctggacgaggccacccacctgccgcccgacgagatcgtcttcatgtcgaccgggtcgcagggcgagccgatgagcgccctgggccggatgtccaccggcgaccaccggcacatcacgatcacctcgggcgacaccgtggtgctggccagttcgctggtgcccggcaacgagacctcggtctaccgggtgatcaaccagttgtcccgggccggcgcgaccgtggtgcacaaggagacggcgaaggtgcacgtctccgggcacgccccggccggcgagctgctctacctgctgaacgtgacccgccccagcaacctgatgccggtgcacggcgagtggcggcatctgcgcgcccacgcccagctgggcatcgagtccggagtggccgccgaccgggtggtgctctgcgaggacggcgacgtggtcgacctggtcgagggccacgcccgggtggtcggtcgggtccgcagccgctacgtctacgtggacggcctggcggtcggtgacgtgagcgagtcgctgctgaccgagcggcggatcctgggcgacggcggattcatcgcggccaccgtggtgatcgactcggtgaccggcaaggtggtcggcgaaccgagcatctcggcgaagggcttctccgaggacccggacgcgttcaatccggtgattccgctgctcaccgcggccctgcaccggtcggcggaggacggcatcaccgacacccaccagctgcagcaggtggtgcggcgcacggtcggccgctgggtgaacgacgcgtatcggcgccgtccgatgatcgtcccgacggtcgtcgaggtttaaaggtgtcttaaggcttcatccgttttcgcacgagctgcgtactccctggcacggtgccgcccccacggcacccgtggcggagggagttctccagatgcagcgcagatcgatcgccgtagctgcggcggtggtggcggcgaccgcggcggcggtcgccttcaccctgccgtcgctggccggcacgacgccgaccggcggcagtggcgcgacgaaggcgagcgggggtgtttccccggaactgctcgccgcgatgaagcgtgacctggggctcgacgcgaaccaggcggccacccggctgaagcggtcgaagtgggccggcggggtgaccgcgaccctggccgcgaccaccggcgacagctacggcggggcgtggctcgcgtccgacggcaccacgctgaaggtggcggtgaccgacgcggccgcggcccggaaggtgaaggccgcgggcgccgtgccggtgctggtcaagcgcagcgaggcacagctggacgcggccaagggccggctggacgcgcaggtgaagtcggccgccggtctgaccgggtggtatgtcgacgcacccaccaacaagctggtcgtcgtggcacggccgggtcagaaggcggccgcgcaggcgctggcgaagcgggccggggtggctaccgacgcggtcaccgtgcaggtcagcaaccggctgccgaagccgctgttcgacgtgcgcggcgccgacccgtacttcatctcgctggacggcggcaccgcccgctgctcgatcgggttctcggtggagggcggcttcgtgaccgccggacactgcggcaccccgggcaccaaaaccagcggcttcaacaaccaggcgcagggcgtggtgaaggcttccgtcttcccgggcaacgccgacatgggcttcgtcgaggtcaacggccagtggacgccgcgtccggtggtcaacgacttcaagggcaacgagcttccggtgggcggcagcaccgaggccccgatcggcgcggcgatctgccggtccgggtcgaccaccggcacgcactgcggcacgatcctggcgaagaaccagacggtgcgctatccggagggttcggtgaccggcctgacccgcaccgatgtctgcgccgagggtggcgactcgggcggtccgtggctctccggcgaccaggcccagggggtcacctcgggtgggtccggtgactgcacggccggcggcgagacgttcttccagccggtcaacgagatcctggcggccaacaacctgaagctgctgaccaccggcggcggcgacgggggcggggcgaccgccgcgccgagcgacagcgcgaccgccgcgcccagcgaggccccgtccgaggccccgggcggcaacggtgacggcaccgcgaacgcctgcgccggcctggccgtgcagcgccagggctcgctcagcaaggccggtaccgcgcaggcccagccggacggcggcgccttccgggcccgggccggccggcacgtcgcctgcctgagcgcgccggccgggtcgaccttcgacctggtgctgcagcggctgcagaacggccggttcaagacggtggccaaggcggccgcggacggcacgctgagcgtcagtgagcgctcgggcaccttccggtacgtcgtggtggccacctccggcaccggcgactacacgctgggcttcaacgtgcagtaggcgcccgcgtaccgccgccatcagaaccgggggaggccggggccgtgaccggccccggcctccctgtcggtcagctctgtccgttgcgccattcgcccagggcgtcgccgagccggcacccggtggcgatgccgcagagcagcacctggtcgagttgttccggggtgacgccgcgttcccagtcggtcgacacctcgcccaccacgacggccgcgccgtcgtcggtgacctgcacgtatgccttgggccagagctggtcgcggttccacgtgttgcagaactcgtagagcctgggcacgtcctcgacggtgaagacatgctgcatcatcgcgcggatctgcagcatctccttgttcgcgccgagccggaagaaatagatcaggtttccctggaagttgccggcgatgtcgccgtccgcgtccacgaagtacgcgaacccgcgcgcgtccagagcggccttgatcatctcgttgtcgagtgattgcacttggtgatcttaatcgccgaaaagcgaggaagggtcacggtgtgccttctcgatggatgtggcgggtcgggctaccgtgtcacccatggcgggccgtactcctccggcgagccggggccgcgccgcgtcaacgccgcgcggtgccgctacctcgcgtgcccggcaaccggctcgtcagccggccaagaaggccgcggccccgcgcaagcggacggcggccacggcgaaacgggcggcgcccccgccgatggtcggcccggcggtcggccgggggatcagcgcggtctggatgggcctggcgacgagtgtcggctgggtcgcccggggcgccggccgcaacgcccgcaacatcggcccggagcaccgccgcgacggcgccggtctgctgctgctcggcttctcgatcctgaccgcggtcgcggtctggggccggggcgccggccccgtcggccagcggctggccgacgcggtgcacctgttcttcggcggcctcggggtcctgctgccactgctgttcttctacggcgcgatccggctgatgcgtcagccggccgacccggagcaccgcggtcgcaacccggtcggctggtcggcgatcatcatcgccatcgcgagcctgctctacatctccgggcccaagggcgacgacgtcgcgctgaccggcaacggcggcctgctcggctacggggtcggctcggtgctggagcgggcggtcagcgtctgggtggcggtgccgctgctgatcctgctgttcgtcttcggcctgctggtgatcacggcgaccccgatcaaccggatcccggagcggttcgtgctgctcggcgagctggtgaccgggcgcaaccggccggtcctcgaggacgacgtcgaggacgacccggtggcggaggacgaggaggcgcggccggcgagggcgcgccggcgcaagccgtccccggtggtcccgctcgacgagatgctggagcccgaggagcccgacgaggacctcatcctgcacgacacggtcgtcctgcccaaggtgccggccacccgccgcaagccgccaccgcccgaccactcgccggccccggtcaaggtcgagcagctggagatctccgcggtggacagcggcgactaccagcggccgccggtcagcctgctcgccgagggcgccccggcgaaggcccgcagccgcgccaacgacgagatcatggcggcgctcaccggcgtcttcgaacagttcaacgtggacgcggtggtcaccggcttcacccgtgggccgaccgtcacccgctacgaggtggagatcggcccgggcaccaaggtggagcggatcacccagctgtcgcgcaacatcgcgtacgcggtgaaatcgcccgacgtgcggatcctctcgccgatcccgggcaagagcgcggtcggtgtggagatcccgaacaccgacccggagaacgtgtcgctcggcgacgtgctgcgctccccgctggcccagcgcgaccaccacccgatggtggtcgccctcggcaaggacatcgagggcggcttcgtcaccgcgaacctggccaagatgccgcacatcctgatcgccggcgcgaccggtgccggcaagtccagctgcctcaactcgctgctggtgtcgctgctcacccgggccaccccggatcaggtgcggctgctgctggtcgacccgaaacgggtggagatgacggcgtacgaggggatcccgcacctcgtcacgccgatcgtcaccaacccgaagaaggccgcggacgccctggagtgggtggtccgcgagatggacatgcgctacgacgacctggccgccaacggggtccggcacatcgacgacttcaaccgcaaggtccgcaacggcgagatcaccgcgccgcccggcagcgagcgggtgatcaagccgtacccgtacctcctggtgatcgtcgacgagctggccgacctgatgatggtcgccccgcgcgacgtcgaggactcggtcgtccggatcacccagctggcccgggccgccggcatccacctggtgctggccacccagcggccgtcggtcgacgtggtcaccggcctgatcaaggcgaatgtgccgtcccggctggccttcgccacctcgtcgctggccgactcccgggtcatcctggaccagcctggcgcggagaaactgctgggtcgcggcgacggcctgttcctgccgatgggcgcctccaaaccgactcgcatccagggcgcctgggtggacgagaaggagatcgcggcggtcgtcaagttctgcaaggaccagcgcgagccggagttccaggagggtgtcaccgacgcgccgccgacgaagaagcgggagatcgacgaggagatcggcgacgacctccagctgttgatccaggcgatcgagctggtggtgaccagccagttcgggtcgacgtcgatgctgcagcgcaagctgcgggtggggttcgccaaggccggccgactgatggacctgatggagacccggggaatcgtgggcccgtcggagggctccaaggcccgggatgtactcatcaaaccggacgagctggaagaatcgcttgccgccctcaaggtggactgacggcagagtcaacttcggcagatccatgtcgcacgctgcggccgataactgatcgccgctcccgccgctcccggttgcggcgattttggccgctggcgcgtccaggacaaatcgccgcaacctaccgtccgtgggtggtctctgaaagaactggggccgggaacggggcacggaaggtgaaggcctccggggtggagccgtcggcgcggaggcggtcgaggcggtcgaggccctgctgcagggtggggagatcgccggccgggagccaccagaggaccagggcggcgtccgggccgtgggggtggaaccactcgcggcggcggcgcagatagtccaggtggtcgctctggtaggcgtatgcccgcagatgcgcgggggtctcccagaccgacatggtgtagatccggccggggtcggcgtcggtggcgatggtgccgtcgccgtcgtcgccgatcaggcgccagacgaagccgggggagcggtcggccagctcgttcatcagggtcaggccggcgacgaactcggccatcgacgggtcggccagcggggcgcgcagccgcgcggtgttgatctgggccaggtggaaggcgctcatgagtcccagctcaccagcccgccgttctaaagtcaatcagtttgctttttacacagagcgacacagcagcggccgggggcggcgtccatccgggcctgccacccggcgtccaggccggcgccggtcagcaggccgtcgaccatggccaggttcatcccgcagatcaccggggggaactgctcggccagccggtggaacgggcagttccgcagctcgatccgctccgggccgtccgccaccgggccgtagccgtgcccggccagcacctcgaacacgtccccctcggccgccgcggcccgctcgccgtgacggcgggccacccggttcagcgtctcctcggcgccggtctcctccagtgcctcggccagcagctcggccgccgtgcggtaggcacgcggcggcacgctgaccacgtgctcggcggtggccacccggtacagcttcgccggccgtccggcgcccggcccggtacggcccgaccggcgcgcgtacgacgtctccagcagcccggcggccaccagcttgtccaggtggaacgcggccagcgtgcgcccgaccccgagcgcctcggccacctcgtcgcgtccgaccggggcgcgggacgcggccaccgtccggtacgcctgccgccgcacgccgtcggcgaggctggtcaccgcgtcgagatcgccgaggtcctccgaagtcgtcacccgaccatcgtattgtcaatgtgacttggtgctagagcttggctgtccgggggacggccatcccccggcggcccggtaaccttggcgggtgtctgtaactcctcctccttctcgccgtgtcgccctcctcaccctgggctgtgcccgtaacgaggtcgactcggaagagctcgccgcccgcctcgacgccgagggctgggaggtcggcaccgacgcggcgaaagccgacgtggtgctcgtcaacacctgcggcttcgtggagaaggcgaaacaggactcgatcgacaccctgctcgccgcggccgacaccggcgccaaggtggtcgccgccggctgcatggccgagcggtacggccgggagctcgcggagaacctgcccgaggccgacgcggtgctcggcttcgacgactacaccgacatcgccacccggctgaacggggtgctggccggcgagaaattcgacgcgcacaccccgcgggaccgccgcgagctgctgccgatcaccccggtgcagcggcacgcggccaaggtggtcgtccccggccacgcgaccgtcgacgagcacaccccggcccacctgcgcaaggtgctgcgccgccggctcgacaacagcccggtcgcctcgctcaaactggccagcggctgcgaccggcgctgcgcgttctgcgcgatcccggcgttccgtggcgcgttcgtctcccgcgacccgcaggagctgctcgccgaggccgagtggctggcccggaccggcgttcgcgagctcgtcctggtgagcgagaactccacgtcgtacggcaaggatctgggcgacccgcgcctgctggagaaactgctcccgcagctggccgcggtcgacggcatcgtccgggtccgggcgagctatctgcagcccgccgagacccgccccggcctggtcgaggcgatcgccggcacgcccggcgtcgcggcctactacgacctgtccttccagcactccagcgagccggtgctgcgccggatgcgccggttcggctccaccgagcgcttcctggagctgctcgactcggcgcgccggctggccccggaggccggtgcccggagcaacttcatcgtcggcttccccggcgagacccggcaggacgtggacgagctggtccgcttcctgaccgaggcgcgcctcgacgcgatcggcatcttcgactacagcgacgaggacggcaccgaggccgccggcctgcccggcaaggtccgcccggagaccgtcaagcggcggtacgaccgggtggtggcgctcgccgaggagctctgcgcccagcgcgccgaggaccggctcggcagcatcgtcgaggtgctcgtcgacacgatcgacgacggcgagatcgagggccgggccgagcaccaggcccccgaggtggacggctccaccacgctggtcgccggcgaccagggggtcgacctggccgcgctgcgccccggcgacctggtgcgtgcccgggtcaccggcaccgagggggtcgacctgatcgccgtgcccaccgagatgatctccgccgcgcaggccgaccggtgaccgacgagccggttccggtggccgcaccccgcgtggtgtcgctctacaacgcggcgaacgcgctgaccgtggtccggctcatcctcgttccggtcttcctggccctggtggtcgcctcccggatgaccgaccacgactggcgggtcggcgcgtgcctggccttctgcgtggcctcggcgaccgacttcgtggacgggtggatcgcccgccggtggcacctggtcacctcgttcggcaagatcgccgacccgatcgcggacaaggcgctgaccggcaccgcgctggtcctgctctccgcgtacgacgtgctgccctggtggatcacggtgctgatcctggcccgggagtggggggtgacggcgctgcggttctgggtcatccggtacggggtgattcccgcgtcgcggggcggcaaactcaagaccgggctgcagacgctggcgatcgtctggtacctgtggccggtcccggcgccgttcgacgtggtgggcccctgggtgatgtacgcggcgctgctggtcaccgtggccaccgggttcgactacgtggtgcaggcgctgcgcctgcgacgtaccgccggcgtctgatggtttaaacgcggccgatctgcccatatcgggatcagttgcgtctgagggggttccatggagatgccggtggccgccgcggcggccgtgcacatgctggtcgagcggcggcagaccctggcgaccgcggagtcgctgaccggtggcctggtcgccgcgacgatcgtcgagatacccggggtgagcgcggtctaccggggtggtctggtggtctatgccaccgagctgaagggcacgctcgccggggtgccggcggccctgttggccgaacgcggcccggtcgacccggatgtggccggccggctcgccgagggcgcccgggaccgctgcggcgccgactggggcctcgcgacgaccggcgtcgccggccccgagccgcaggacggcaagccggtcggactggtctatgtggccgtcgccgggccgcccggcacccgggtgcgtgagctgaacctgaccgggaaccgggcggcggtccgcaccgaaagtgtgacggccgtcctgcaattgctcaccgacgtgctgcgtgccgcgccggcttcagtctgagcagggaatatctccgctgatgcgccggttgtccggttgtgccgcgcggggcgggccccgaggaattcggcggggcgggatgtcgccgtcgctcgcggcaggtacggttgcgggaagcctccggcgtgttgccggcggccccgcccgcaggaggaggtgccatggtcctgctacgccgggttatcggcgacgcacttcgtgcgcgccggcagggacagcaccgcacgctgcgcgaggtgtcgaccgccgcgaacgtcagcctgggttatctgtccgagatcgagcgtggtcagaaagaggcctccagcgagctgctcgcggccatctgcgacgcgctcggcgcccgcctgtccgagttgctcagcgaggtcagcagcacgctgtcgctcgcggagaacatggagggcgtgctggtgccggtcgacgacaagccgggcgagccggcccgtcaggtggcgaccgacggcagcgtgtcggtctcggtgcgccaggagtcgcccctgaaggcgacgctgcacgccacccgcaacaagaagcgggacgtggtctacgcggcttagcgacgcttccggcgtcgtctccgtgacatggggatcccgcttgcgccggccggtggccgtggccgcgggattctgtcgttcccccgtcgccggctcccgcgatccggactgttcgctctccgccgaatccgggcatccgtgcccgcgactgtggtgctgctcacccacggtgggtgggttgcccggccacgggtggggttcacgacgtaccggcgcgtcggtgtgagcgggaccggagggaccacatcgcgcccgaaggatgatttcggcgccgccgccggtggcggcgggcggttctagggggcttccgaatctcgctcgggagacccgaggggcgtagcctcgttctcaggctcgaagccaggggagaccctgagatcccccgtaggtcgcgtgacgtcactggcatcgggctgacacgatggtttcgcgtcggcttccgggccgcgacgcgaccgaccgagcgacattgaggggataccgcgagatggcgaacccgttcgtcaagggctggcattacatgatggcgctcttcggcgcgaaaattgacgagtacgccgacccgaaggtgcagatccagcaggccatcgaggatgcgcagcggcagcaccaggcccttgtccagcaggccgcggccgtcatcggcaaccagcggcagctcgagatgaagctgtcccgccagatgtccgaggtcgagaaactgcagggcatggcgcggcaggcgctcgtgctggccgaccgggcccgggccgccggcgacgaggccgaggcgcagaagtacgagcagacggcgcagaccctggccacccagctggtctccggcgagcagtcgatggaagatctgaagacgctgcacgaccaggccctcggcgccgccggtcaggcccgcaaggccgtcgagaacaacgcgatggtgctgcagcagcgcatcgccgagcggtcccgcctgctcagccagctggagcaggccaagatgcaggaaaccgtggccaagtcgctggagtcgatgtcgcagctggccgcgccgggcaacacgccgtcgctggaccaggtgcgcgacaagatcgagcagcggtacgcgagcgcgatgggccgcgccgagctggcgtccaactcggtcgagggccgcatgctcgaggtgcagaagtccagcctggacctggccggctcgtcccgcctggagcagatccgggccagcatggccggcgacaagctgggcggcgcggccgcccagccggcggtcggcggtcagcagaacgccacgccggccgacgcggcgggggtggcgcggctcgacgagatccgcgccagcatgaaccagaagcgcggcgacaccacggccgccggctgaccgacaccggcgctcgaaggggcatgaggtggacgagcggagcagatacttccgccggctcaagaaactgcgtgggtcggcgcgacggtggagtgtgctcggcggcggcctgaccgcggcggccatggtgctggtcccctacgcggggatcggcatcgcggacgccgcgtgggccgccggggccggtgcctcggtggtgctggcccgctggcggtggcgtgactaccgcgagctgtccgcccagcccgcccccgagccggccctgcccggcccccggttcaccgccgccctggaacgcacccaggtcggccgcaccgtcctgcacgaggtgcgccggcagaagaaccggtatgcgatgcgtggctccgcgatcgccgacgcgtgggaccggctcgaccgggcctcgaccaccatggtcgggctggcgggccggctcaccggccccggcgagaccgccgcgctggaagccgccaccgccgaacactggctgcgagacctcggccagcgggtggccagcgtcgaacgcgccatcccgctcgggcagccggctcagcgagccgcgctggagcagtcgcacgccgccctggccgagcagttcgtcgagggcgtcaccgccttcgaggagctcgtggcggcggcggcgagctatgtggccgaggacgggcatccggtcgcggacacccggcacccggcgtatttcgggctggtcgacgcggcggaacgcctgcgcggcatcgccgagggactcgccgaactgcgggaccggacggcccggttcagttcgcccgggccggctccggctggcagcgggggcaccagtatgtgatgcggtcctccagctccgccttcgtgccgatccggccgctggtgatccttatcggggagctttcggctcgctgagttcctgcctgctggaggggccgtccgctctctaccttctggacgggccgtccgctttccagcttctggacgggccgtccgctttccagcttctggatggctgctccgcatcggcggcacggctgggcccggcgcccgtacacgtagctcgtctccccgcgccgcagcgagccggtggtggtctgcgtccaacgcccccggttcgaggcgaccagccgctgcgccagcaccaccgtgccggtcaggtcggcgacatccgccacccgggtccacggccagaggccgcgcaggaacaacgtctccgccttgtacagattgcccaccccggccagattccgctgatccagcagcgcctcggcgatcggcacctccgggcgggcggcgatccgacgggacgcctccgccgggtcccagtcggcacccagcagatccggccccagatggccgaccaggctgtcctcgtcggcggtccggatcaggctcagatcgtgcaggtgatagccgacggcgaccgagcgggcagttcgcaacaccacccggatcaggtgcgcggggcggccggtccagcgttcccccggcgcatacgtccgccaggcgccctccatccgcagatgcgaatgcagggtgtgcgggtcgtgaccctcccgggtcaggcggagcagcagatgcttgccgcggctcgccgactcggccaccgtccacccggtgaggtcggtggcggccaggcgcggcacccggaagtcacagccggtcagcacttcaccggtgagggcgcgttccacgacccgggcggtgttccagacggtgtctccttccggcatacctccaatttatgccgttccgggccgatcgcacttcggcacctcgtcggggcgtccgccgatcttgtgtccgttgccggttcggcggtgtccggtcaccggtctggtttacggcgccggttcggcggtgtccggtcaccggttcggtttccggcgcccgtttcagcggtgtcggtcctcggtctggtttacggcgccggttcggcggtgtccggccaccgatcctgttgccgcggttggcttcagcggcgttcggcgatgcgcaccatgtcgccggggacgaccgagaggaccacgacggcgcggccgttgttcaccgcgatcgccacctggtcggccgaatcggtgtacaccagcaattcgccggccccgacatcggcgaacgtcgccccgcgccgggcccggaccgtgccgttcacggtgagctcggtgccgagcccgctgagcagcgccccctcggcggccagctggacgttgccgaaccggtcgacggtcagcacctccgcctcgatccagccgtcgccgacgctggcgaccggatcgggcagacggaccagcgaagccgggtcgagcgccggaccggcctcggacggcgcggcgccgccggcgagccgcgccgccgccggagcgaacacgtcccggccgtggaaggtccgcgagacgtcgcccagcgtccactccttgttgcccagctcgtgggccgcggtgatcccgccgagcgactcggcggcccagatcagcaggccgttgtccgggccgacgagcaacccgcccggggtggccagcaccaccccgcggcgcgccgtgccgacccccgggtcgaccaccgcgagatgcaccgacggcggcagatgcggcgcggtctgggcgagcacggcggcacctcgggtcacgtcggccggcggcacgtgatgcgtgacgtcgatcacccggacatccggggcgacccgggcgatcgagccgtggcaggccgccacgaacccgtcgaacgtgccgtaatccgtggtgaagctgatccatccgtaaccggccatggtggccaagttactgccagtcgccacccgatgcgcccgggcacgccgcgcggatctggcagggttgacgtcatgcgtctcgtgatcttcaccgaaccccagcagggtgccagccacgacgacctgctccgggtcgccaaagccgccgaggacggtggcttcgacggattcttccgctccgatcactacgtcaagatgggggacgtgtccggcgcccccgggccgtccgacgcctggatcacgctggccgcgctggccgtgcagacgtcccggatccggctgggcacgctggtcagctccgcgacgttccggcttcccggcccgctggcgatcgcggtcgcccaggtcgacgcgatgagcggcggccggatcgagttcgggctcggcggcggctggttcgacaccgagcaccaggcgtacggcatcccgttcccgccgctgggtgaacgcttcgaccgcctcgacgaacaactgcaggtcatcaccggtctgtggggcaccccggccggtgagacgttcagcttcgacggcaagcactaccggctcaccgactcgccggcgctgccgaaaccggtgcagtcgccgctcccggtgatcgtcggcgggcatggcaagaagcgcaccccggatctggccgcccggttcgccgccgagttcaacgtccccttctccaagatcgacgagctgcccgcgcatttcgaccgggtacgtgcggccagcgccgccatcggccgcgccgaacccccggctttcagcgccgccgccgtcctctgcgccggccgtgacgacaccgaactgcgccgccgcgccgccgccatcggccgtgaggtcgaggagatgcgggagagcggcggcgtggtcggcacgcccggcgaggtggtcgagaccatcaagcggtatgccgaggcgggcgcatcccggctgttcctgcaggtactggacctgtccgacatcgagcacatcgagctggtggcctcggaggtgctgccgcacatctgatcggctgatggtggccgcttccccaccccgggcagaagcggtcaccacccgcgcggtgtagccccgggcccggccgcgcgcagcggcgccgctcacccgccgccgctcaccctcgtagccgcaacccgcgcggcgtagcccggaacccggcggcggtcagcgcctcccgcagcgccgccgctcacccgccgccgctcaccctcgtagccgcaacccgcgcggcgtagcccggaacccggcggcggtcagcgcctcccgcagcggcgacgcatgcaccgattctccgtccgcccgttccaccgacatcgccccgagcgccccggaccgcaccgaggcggccagcgcctgcccggccgcggtcagcgcctccggatcgtccgcgaacgacagcagcgtccgcccgccgcgttccacgtagagcacgagctcgccgccgaccagcacgacgagcgcccccgccttgcgtccggcccggtgcccggctttggcgaccggctcaccgtccccgctgtcgacgatccgttccggccagggcagcgccgccccgtacgggttggcgggatccgacgcggccagcaccagcccgcccgccccggtgcgtttggcgagttccgccggctcggccagggcccgcagccggtccaccgcgccgggcaccgcgaactgcgcggccccgagcccctcgacgaagtagccgcggcgggccgccccgcgttcctccagcgcgctcagcaccgggtagaccgccgcgaacccaccggtcaccccttcggccatcaccgcgccccgggtcaccaccccgtggcgttccaggagcaggtcggcgagggcggcggcccgccgggtcgggtcggggtcccggtcgggcagccgggaccagcggccggccatgttcagcggcccggtccgggacggcaggtgcggccgcccgggccgccggtagcggcttcgggccggcgcggctttcgcccggtgcgcgccgctgccgccgagcaacgcgcgcagtggggcgaacgtgtcgttggtcagatgcccggcccacaccagatcccagacgacggcggccaggtcggtgtcgtcggtcgagccggcccggtcggacagcgaccggaagaacagcgcctgcccgtcgccgagcgcgtccagcaccgcctggtgggccggggtgagcgcgaactcctcgtccggcggggggagcagcagcggcgcggagtccgcgtaggccagggtcacccacccgtcgccacccgcgatcgacccggacccggcccacagcacctcgccgctgccgcacaactcgtcgagttgcggcggggcgtagtcggcgatccgggccggcaggaccagccgctcccacgcggacgccggcacggccagcccctgcacctgttcgatgacggcggccagcgcgtcgacaccgcgcgcgttgccgcccacctggtgccagcggggcaggaacgcggccagcaccttcggcgggaccggttcgatctcccggcgcagcgcggccagcgaccgccgccgcagcatgcgcagcacctcggcgtcgcaccattcggtgccggcgccgtccggggagaattcgccggaggtcacccggccggtcgcggacagccgtttgagggcctgctccaccacgaagacgccgagcccgaaccgggccgcgcaggtcgccgcgaggaacggtccgtgcgtgcgggcgtagcgggcgaccaggtcaccgagcgggtcggcgaccggctccaggtacgcctcggccagcccgaccggcagggccaccccgagggcgtcccgataccgccccgcgtcgtcgacgccgatccagcgttcctcgccggccacccgcacccggatcgcccggcgggccgactcgagcgacaccacccagtcctccggcacgccgcgttcggccagctcggccggggagaggtcgccgaggagccggagcagctcggccgcgtcctcggcgtcgcgcgggctgcgctgggtggtccgccattgcagctgggcctcggtctcggtgaccactcccgggtcgagcagctcgcgcaggtcgacccggccgagcagctcgccgagcagcgtcgcgtccagggcgagcgcggcggcgcgccgctcggccaggggggcgtccccctcgtacaggaaagcgccgacgtagccgaagagcagcgatcgcgcgaacggcgacggccgcggggtttcggtctcgacgaggcggaccttgcggccggcgatctcgcgcatcaggccggtcaggccggggacgtcgaagacgtcctgcaggcactcgcgggccgcttccagcgtcaccgggaagtcggcgaactcgcgcgccacgtcgagcagttgcgccgaccgctgccgctgctgccagagcggctgccggcggcgcgggtcccgacggggcagcagcagcgaccgcgccgcgcactcgcggaaccgggaggcgaacagcgcggacgtgcccaccgactcctcgacgatctggaggatctcctccgggtcgaaggcgaccaggtcggcgccgggcggctcctcggcggtgtccggcaaccggatcacgatgccgtcgtcggagggcatcacctgcccgtcgacgccgaaccgttcaccgagccgccggccgatcgccagggcccacggcgcgttcacccgggcgcccagcacgcagtgcacggtcatccgccagtcgcccagctcgtcgcggaaacgttcgacgacgatcgtccggtcgtcgggcaggtgccgggtcgactcgcgctgctcgcgcaggtagttcaccaggttgccggcggcccactcgtccagcccggactcgcgcagcgcggtggtggcgcgctcgtcaccggccttgaccagcgcccgcagccgcgcaccgatcgcccggcccagctcgatcggccggccgggggagtcccctttccagaacggcatccgggccggggcgccgggcgccggggagaccagcacccggtccggggtgatgtcctcgatccgccacgaggtggaaccgagcaggaagacgtcgccgacccgggactcgtacaccatctcctcgtcgagctcgccgacccgggaggctttctccgagccggccaggaagacgccgaacatgccccggtccgggatggtgcctccgctggtcacggcgagccgctgcgcaccggggcgaccggtgagcaggtcggtgccccggtcccagacgagccgcgggcgcaattcggcgaaggcggtcgacgggtaccgcccggacagcatgtcgaggaccgcgtgcagcgccgactcgggcagctcggcgaacggcgcggcccgccggatcagtgcggccagctcgtccaccggccaggcatcgagcgccaccatggcgacgatctgctgggcgagcacgtcgagcggattgcgcggatagcgcagctcctcgatcgccccctcactcatccgttccgccaccacggcgcaggacagcaggtcaccgcgatgcttgggaaagaccaccccgcgcgagacggccccgacctggtgcccggcccggccgatgcgctgcagcccggccgcgacggtcggcggcgcctcgatctgcaccaccaggtcgaccgcgcccatgtcgatgcccagctccaggctggaggtggcgacgacggcggggagccgcccggatttcagcgcctcctcgatctgcttgcgttcctcccgcgaaacgctgccgtgatgcgcccgggcgacgacgggtgccgccccgagggtcgctccggcctgcgccatcaccgctgcgggcatcccggcggcgccgttgccccggaaaccggcgggctttccgcccggccttccccccggcgccgggccgttgccggtcccgcttgttgctttcccggtacgccggaacctccccccgccgcgccccatcggcatccccgagcccagcgagtccgccgacggccccgccccgagttcgtcgagtcctgccggtagtcctgtcccgagttcgtcgagtcctgccggtagtcccgtcccgagttcgtcgagtcctgccggtagtcccgtcccgagttcgtcgagtcccgccggcgggcctgccccgagttcgtcgagcccagccttcgcccccgccgtgggtccgtcgagccgtgcctgcggcgctgctcccggcggccccacggggtctccggacccgccgcgccacgggacctcaccgtgctcggccgcctgctcgccgagccgcgccagctccacccgctccgccgagagctcgttgagccgcgcgcacaaccgctccgccccgcgccgggagttggtgaagacgatcgtcgaccggtgcccctcgatcaggtcgagcacccgctcctcgaccgccggccagatcgacggcgtgtgccgcccgccgtcgaggtcgtcgcccgcgggtgactcgtccagccgggtcatgtcctcgaccggcacctggacggtgacgtcgatggtcttggtgctgggcggccggacgatctccacgtgctgcgggccgccgaggaaccgcgcggtctcctcgatcgggcgcaccgtcgcggacagcccgatccgctgcgcgggccggtccagcagcgcgtcgagccgttccagggagagggccaggtgcgccccgcgcttggtggccgcgaccgcgtgcacctcgtcgatgatcaccgtttcgacgccgcgcagggactcccgggcggccgaggtgagcagcaggaacagcgactcgggtgtggtgatcaggatgtccggtggcgtacgggcgaagccgcgccgctcgtcggcgggcgtgtccccggtccgcatcccgacggtgatctccggcgggggcagcccgagccggccggccgcctgccggatgccggtgagcggcgcccgcaggttgcgctcgacgtcgaccgccagcgccttgagcgggctgacgtagagcacccggcagcgacgccgcacctgctcgggcaccggctcccgggccagccggtcgagtgaccagaggaacgcggccagcgtcttgccggagccggtgggcgcgaccacgagcgcgtgccgcccggcgccgatcgcccgccacgcgccgtcctgggcagcggtgggcgcggcgaacgcggccgtgaaccacgccctggtggccggaccgaaattctcaagcacctctcgcacgcccaccatcctcccccgggggtacgacaaaaacccgccgccgagacccacgcggggcccgggtgatcggcgttccttgggcggtctgtgcctgattatcctgatagccgacgtgatgggtgggtgccgatggcggtcaggcagatgctcgtcgcaggccggtaccgattgctggaaccggtcggcgcaggtgggatgggacgggtctggctggcccgcgatcagatgttggaccgggacgtcgcgatcaaggagatcgtcccgccggactggatgagcgaggcggagaaggaccgtctgcacagccgcacgctgcgggaggcgcgcagcgcggcccggctgacgcatccgcacgtggtgcgggtgtacgacgtgctgcacgacgacggggtgtcgtggatcgtcatggagtacgtggcgtcccggtcgctctaccaggtgttgatcacccaggggccgtactctccggtcgaggcggcccggatcggcctggccgtgctcgatgcgctgaacgccgcgcaccgcgccggggtgctgcaccgcgacgtgaagccgcacaatgtcctgatcgggttggacggtcgtgtgctgctgaccgatttcggtctggccaccttcgtcgacgacggcatggtgaccacaccgggcctgatcgtcggctcaccgcagtacgtctccccggaacgggcgcgggacggcgcctccacggtggcggcggacatgtggtcgttcggggcgacgctgtacgccacggtcgagggtcagtccccgtacgcccgggacagcgccatggcgacgcttgccgcgctggcgaccgaaccaccgaatccgccgctgcgggcgggtccgatcggcccgatcctggaggggctgctccggtacgcgccggaggaccggctgtccgcggacgagaccgagcgacggctgcgcgcggtgctcggggagaccgggccggccgccgcggcgaggcccgcgaccgtggtcgcgccggtgaccaggatggtcgccgaggactcgccgacggtggcggccgttgcaccgccatccgaggcaaagaccgattcggatcgtacggaggtggtcccggtcgctaccggcgaactggttcgcaccgcggatctggcggggaccgggctggtcctggaaggggagtcgggtcccgccgaatttcccgaggaggacgaggcggatcacgacgatgacgccgaggactcggacggctggtggcagtccgggcgcggctacatcgacggcacgttcaccgtcaccgacgatctcgatgccggctccgtcccggcggccgccggccactcgcactacggtgccggccggtggaccgacggggggaaccgggccccgagcagttccggcgtgccgcgcgcccaccacaatcggcaaccctccgcggccgggcggccggcggccacccggttgctgcgccgtgggaaccaggcgacggtacgcggtatcccctcgccacgcagcccggtctccggcccgttgccggacaccggggtgccgcccggacgctgggcactgcatccgctgccggcgaaacggatctccacccgcgcggtgctcgccggtctgctggccgtcgctctgatcagcggcagcctgctcagcgtccatctgatgcagcgggacgactccgccccgcagatggtgcattcgcccatgccggccccgtcgggcatgtcgtcctccgggatgtccccatcggacatgtccccatcggacatgtccccgtcgggcatgtcgtcgtccggcatgcccgcgtccgggatgtcaccgtcgagccgggcctcggcgcccgaggcgggcgcgtcacagccgcgggcatcgccgaccgggtccgtctcgccggtgaccgccggtttctcgccgatcgtctgcgacgcgccggcgccgcaccatgccccggtggcgccgcaggccggtgccggccgcggcgtcgacggctggcgcctgcaggccggctggtcgtacttcaccgacgggaccggattccaccttccggtcccggacggctggacctatcagcggatcggcagcacgtactgcttccgggagccgcgcggaggccgggtgctgagcctggacgtgggccggccggccgcgaccgccccgctccagggatgccgtgccgaggaccggcggctgcgggcgagccggcaggtccgcgactaccgggcgatgtcgctggccccggtcgtcctgctgcacgcggcggtcgactgggagttccgttaccgcacctccggcggtgtgctgcggcgcgccaggacccgctggctgtcgatgggtggccgggcctacgccctcggctgggccaccccggaggccgcctgggccgccgaactgggcaagctcgaaatggtgtggagcaccttctacaccgacggcggcaccccggccagcgccagccgcggctgacgagcggtccggcgtgagcatgcggctgaccagcggtcgggcgtgagcatgcggctgaccagcggtcgggcgtgaacatgcggctgctcgggcgggtcagccgtgcgcccgcggctgctcggctgggccgggcgtgaacatgcggctgacccgtgcggtcagtcgagcgggccggacccgctccgtcagctcaggctggcggtggccagcttgatgctgaacccgacgaacaacgcgccgaccccggtcgcggccccggccgccagccgccggcgccgctggaactgcccgaccaggaagcggcccccgaagatcagcgccgtcaggtacagcgcgctgaagaactgcaccaccgcacccagcaccaggaacgacagggcggggtgcgggtagcccggctggacgaactggatgaagaacgagacgaagaacaggatcgccttcgggttgagcagactgatcacggcagcccgccggaacggccgctgcatctcggccggctcctccgtcgcctcggtggcggacacctcgccccggccacgccagcgggcccgggcgccgcgcaggatgccggccccgacccaggccaggtagccggcgccggcgtatttcagcaccaggaacagcggcgggtaagcccccagcagcgaggagaccccggtcgcggagaggaccatgagcaccgtgtcgccgaggaagaccccgcacgccgcctgatatccggcccgcacgccacgacgggcgccgaccgacagcacgaagatcgagttcggcccgggcagcaggatgatggcgaccacacccagcacgtacgtccagaaatcggtgatgcccagcatcagtcgcgcctccccaggccgatcagccggcagccaagcggtcccgcaggcgccgcgccgcggccggccactcgtccgccgtcatcgcgaagactacggtgtcgcgccaggtgccgtcaggtcgcagacgctgccgccggagcagcccgtcccgaccggctccgagccgggcgatcgcctgctgggagcgctcgttgcgaatatcggtgtaccagaacaccttggccgcgccgagcacgtcgaaagcccgctccagcagcaggagtttggcctcggtgttcaccccggtgcgccaccacctgcggcccagcatggtgtgaccgatcccgaccgaacggcggtccgggtcgacgtcgtggtaggtcgtcatgcccatcaccacgccggtgaccgggtcgacctgggcccagccggcccggtcaccgcgccactggccccggatcacctcggcgacgtcctcggccatgtccgccacgctgctcgcccgctgttgggggatgtggcgccagacctcctcgtcgtcgagtgcctcgaacaggcccgcggcgtgtgccggcgacagcggctccagccggaccagccggccctgcatcagagccggggtctgccactcggtcgccgggttgccgggcaggtaggcgggcggcggcacggcgacgcccgcgtcgctctccggtgggccggcgacccggcggatcggcagcaccccggcccagtgcggcaggtccagatcggccggctcgtcgaccacgccgccctccctgacccgggccgacacctcggcgagcggcagcgcgagcacgctggtctgcgccatctcccggtcggtcggcggccggctgcccgcggcccggccggcgcccaccttctccaccagggcgtgcatggccgccgccttctccgccgggtcggcgaccggacgggcgacgccatgcgcgatcaccgaacggtagttggcgctgtggtggaaatgcgagcgcccgtagaccagcccgtccagcagggtcacgctgacgcagaccgggacgccgtcaccgcgggcgccgagggccagccgggcgccggtggacccgtgcagatagagcgtctcgccgacgcggacgtgcagggtcggcagcacgcgtggctcgccgtcggccacgaaggccaccgaacagtcatacgcctcgtccagaatggcgtgtgcccggtcgcgctcgtagtgcatgcgctggcgggtccgggtcgcggtggtgcggtcggtagtcgcgtagacctcggtcatcaggacctcccgggagggcgaaaccgcttgctttcgcctttgtactagtacagaatcgtctgtgtggcagaacagtatcaggtcagtggtgggaccgccgccgagatttcggccagcatcgagaccggcgtcgtgcgcggcgactggcagttcggcgccgccctcccgccggtgcgggtgctcgccaccgcgctgcacgtgagtcccgccacggtcgccaaggcctatcaggagctgcggcaacgcggcgtcgtcgagaccgagggccggcggggcacccgggtccggtcccgtccgccggtggcgctctcccggtccgccctgcggcccccggtgccggccggcctgctcaatctctcctccggcgagcctgacctgagcctcctgccgcccctcgggccggccctgcgggtgatcgccgaccaggtcggcccgccgcagggctacacctcggcggcgaccatgccggagctgatcgaggcggcccggccccgcctgctggccgagggcgtgccggtcgccgaggccgcgatcgccgtcaccgccggcgcgctggactcgatcgagcggctgctcaccgcccacctgcgaccgggtgacgcggtcgccgtcgaggatccgggctgggccaacctgatggacctgatcgcggctctgggcatgcggccgctgccggtcgcggtcgacccggacggccccgagcccggctcgctcgacgccgccctgcgcgccggcgcccgagccgtagtgatcaccgtccgcgcgcagaaccccaccggcgccgcggtcagcgccatccgcgccgccgagctgcgcgacctgctcagcgaccatccggacacgctgctgatcgaggatgatcacgctgccgagctggccgaggcgcccccgcactgcgtcggcccggtgacccggtggtgggcgttcgtccgttccgcctccaaaccgttcggccccgacctgcggatcgccgtgctggccggcgacgagacgtcgatcgcccgcgtcgccggccggatgcggatcggcatgggctgggtctccaccgttgcgcagcggctcctcctgcagctctggcgcgacccggaggtcactgagctggtcgccgccgcggcccggtcctacgggtcgcgccgccgccggctgcgccatctgctccaggcccggggcgtccgatcatccggcgacaccggcatcaacgtctgggtgccggtccccgacgagacccacgcgatcgccggcctgcgcgacgccggctacgccgtggcgccgggcgcgctgttccggatcgcctcaccgcccggcatccggatcaccgtcagccctctcgccgagtccgacatcgaggccttggccgacgcggtgtcgaccgtcgtccacccggccgccacggggctgccgatgagatgacctccctggagaccccgtcaattctcccgaccgaccgcgggcggtccagatccgcgccggctcccgcttccttgcgggacaggccgttggcgggtccgtgggttcgtgcgccggttcgggcttgctgccggcgggcggcggcgggttccgtaggttcgtgcgccggttccggctgctgccgtcggatcgtggctggtcgaggtttcgcgcgccggttccggcttgttacccggcgggccgtggccggtccaggtccgtgcgccggttccggttcgctgggggcgggccgtggccggtccaggtccgcgcgtcggttccggttcgctggggcgggccgtgggcggttcgggctgcgggcttcggccctggccgtccgattgttgcggtacgcccattggcggcggccgtcctccgggagagtggcccggtcggcgtgatcggtcccgggccgggtagaacgtacgcatgtcacggaccggaggtccggtcggcgcacagcaatgggtgccaccgcggccgcacagcatcgacgaactcaagcaggccgcagccgggtgtcacggctgtgagctctacgagaacgccacccagacggtcttcggccggggcgccccgaacgcgaagatcgtcttcgtaggtgagcagcccggtgacatcgaggaccagaagggcctgccgttcgtcggcccggccggccggctgctccgcgacgccgtggacgatgccggcatcgaccccgccgacctctacatcaccaactcggtcaagcatttccggttcgagctgcgcggtgcccggcgcatccaccagagtcccgggccggcccacatcaccgcctgccgtccctggctggtgagcgagttcgccctgctgaagccgcagctcgtggtcctgctcggagcaaccgcgggcaaggcgctgctgggcccgtcgttccgggtgaaccggtcccgcggccagctgatgccctggccggcctccgccgagcatcccgaggactttccggtggccgagatcagggcgctggccacgatccacccctcggcggttctccgagcggacaaccgggacatcgcctatcagggcctggtcgacgacctgaagatcgccgccgccgcgatcaccgcctgatccgttcagccgctcgaccgccacccactcatccgcccggaggtacctgcctgagccgacaggtccacgaactcggccggcaagagccgtcgtaggaggcatctgcacggcctgagcgggccggcctggtgtgttcgcgggccggtcgtcgcggaacaggcggcggatgccgggttcacgggcggccgggctgaatccccgactggccgagcgggcggatgcgtccgtcttccggctgactctgccggctccacgtgccgtccagtcgtggggatcgttcgcgccgcatcgggtgaacgggtcgtccgggtcagaaacgtcggccgggttcgttcgtgaaccgacgtccgccgggacctcgggccgtgaggtaccgagttctttcaccgccctcgtgctgcagggtgccagagctcacaatgagcggccgcgattcgctgaacgggctgtcggcggaccggatgggtaggctcgaacggtgcgactgacggacttctggggacgccttgaacaggcgttcggcgcggcctacgcccgcagcatcgcggccgatcacgccttcgcggagctggacggccgcaccattgagcaggcgattgcgcagggtgtcgacacggctaccatctggcgcgccgtggtggcctcgtaccccgatcgggtgccttccaggctgcactgagtcattcttcgtacgcttgttctggcgtgtcgctcgatgtagtacatgtgttcggctattgtccacagcggctcggccatccacagccctcggtagggcggaggatttttgtcatacccaccgcataccgtgtcggccgtggcgaagaacgcgaagtccaatacaggggtgacagcaatggtggcagcaccggaccgggaaaaggcgctcgaactggcgctggcacagatcgacaagcagttcggcaagggctcggtgatgcggctcggtgagcggccggtcgtgcagaccgccgtgatcccgaccagctcgatcgcgctcgacgtggcgctcggcgtcggcggcctgccgcgtggccgggtcatcgaggtgtacgggccggagtccagcggtaagaccaccgtcgcactgcacgcggtggccaacgcgcagaaggccggcggcaccgcggcgttcatcgacgcggagcacgcgctcgacccggactacgcgcgggctctcggcgtcgacaccgacgccctgctggtgtcccagccggacaccggcgagcaggcgctggagatcgcggacatgctgatccgctccggtgcgctcgacatcatcgtcatcgactcggtcgccgccctggtgccgcgcgccgagatcgagggcgagatgggtgacagccatgtcggtctgcaggcccggctgatgagccaggcgctccgcaagatcaccggcgtgctcaacaacaccggcaccacggcgatcttcatcaaccagctccgcgagaagatcggcgtgatgttcggctcgccggagacgacgaccggtggtcgcgcgctgaagttctacgcctcggtccggctcgacgtgcgccgcatcgagagcctgaaggacggcaccgacgtggtcggtaaccgcacccgggtcaaggtcgtgaagaacaaggtcgcggccccgttcaagcaggccgagttcgacatcatgtacggcaagggcatctcccgcgagggctcgctcatcgacgtgggtgtcgagcagagcatcatccgcaagtccggcgcctggtacacgtatgacggcgaccagctcggccagggcaaggagaaggcgcgggagttcctcaaggagaacccggacgtcgccgccgagatcgagaagaagatcctggagaagctcggcgtcgggcagacctccggggacgctgccggtggccccgagctgccgccggtcgacttctgatccggtaatccgacatggccggacgacgtggtgcccggtccgggcgcggctgggatgccctcccgccccggtccggcgccgatgcgccggacgacgaaaccccgggccgcggcccgggccaagaccgtcgcgattccggtcggcgtggctctgcggcccgtcgccggccggacgctgacgaccccagcctctggcagaccttcggttcctccagtgaggcctccgatgacaccgacctgtccgaagcacccggcgatgaccccgcctccagcgacgccgggtctgccggccgcttcggcgggcgcccacgcgaccgctccggcggtccggccgttcaaggcctgccctggagcggccaggcggcttccagcgatcagcccgtcgggagatcgggccgttcgggcggcggagcttccgacggtcagcccggcgggagatggggccgttcgggcggcggagcttccgacgatctgcccggcgggagatggggtcgttcgggcggcggagcttccgacggtcagcccggcgggagatcgggccgtccgggtgccgggggttccggcggtcagttcggcctagagatcggcggcccggagggcgaggggtcggacggtcggttcgccctgcgagcgggcgctcggggcggcgggggtgccggtgagcggaaaccggcgggacctgcgcagagtgagtcggagcgggcgcgggagatctgcctgcgccagcttgcggtgcggccgcggacacgtgccgaattggccaaggtgctggcccggaaggagatctccgaggaggtgatcgccgaggtcctcgatcggtatgacgaggtcggcatcatcaacgacgcggcgttcgcgcgggcctgggtgtccagccggcaccacggtcgtggcctggcgcgccgggctctcgccaacgaactgcggcagcgcggtgtggacgccgaggtggctggagaggcgctggagagcgtcgacgacgagtccgaggcagagaccgcccgggcgctcgtcgaccggaagctgcggaccgccagcggcacgccggaggcggtgttccgacgcctggtcgccatgctggcccgcaagggttatccggtgggcatcgccatccgggcggtcaaggaggcccttgccgcccgcgacgcggaagccgctgagttcgctgacgccgtggacgccgatgccctcgccgaccaggccgaagacccgcactcctgaccccgccggaacaggaggccgcactctgccgaaacagtgcgtccgactttgaccgggcatggcgtggcgcttcgtcgggacggtgcgtctgaccttgccgggtatggcgtggcgctctgtggggaccgtgcgtctgaccttgccgggtatggcgtggcgctctgtggggacggtgcgtctgactttgccgggtatggcgtggcgcttcgtcgggacggtgcgtctgaccttgccgcggaggggtgcccccgggtcgcaggcggccggcgatggttcaggtcagggctcctggtgtgcgggccgctgtaggcgactgttctgcgaacgcggggatgccggcggctgggctctgtcggctcggcggtgagtagggcggttcggttgcgcttggtgacgtctggtcatgagcggagagaagttgtcgagggtcttcgcggagggctgcggagacgcttcgcgggtgccggcaacctgtccgccggcaggctgagaatgtggtcagacactgagcggacgtacgtagcggcgggcgcccgttcccggaaggcgggatgcttggacgggcgagccggggcattcgtgaggtataggcggtccagggcgatatagtccggatgtgaaaactctgcctgttcggggagaagctccggatcggtgggtgtcggcctgctgtcgtcacgctcggtgtggtgtgagggcggttgccggcgggcggaataatggctgaggggcttttccagtgtgctggccagcgggtgtgggccggtcctggaagtactcgatgtggtggcacgtcggaaatatccgggcgatatcgtgagctgggcgtaagcgggtctgtgccctacgtcctatccgctgccgaatcatgagtccttgaccgaagcggcacttgcgacctagcctcgcgttacacaaggtttgctcgaccatcgcaagcaacacacacaacatagatctcattacattacggcatcacttgacgggcctggtccgtcgaaggcgtcgcctcccgctgaccgcgcgggggtggtgagatattcagcggtcgacctacaactccacacacactctgatcccgagtcaccatccagcgacccggacgcggaggccgacggcactcgccggcggggtccgacagagcttcgacgggaggaaaccgcgcgaggcattgtcacactccgttgacgatcgccggccgggttcggcgacggaacgaggcgtgacggggcggcgtggcgctcgcgagccggttggcgcagcgggcggcaggtcggacggattccgtcccgggcaaccgggcggcaggccggacgactccgcgccgggcatgcgggcaggtcggacggctcccgtcccggactccgggcgggcaggtcgcccggcaggcgatgctgcccggcgacggcgcgctcgggacggatccgacggtccggctgaaacgtgccagacgccgaaccgtcgcatgccgcaccgaccccgcacgacgcaccgacgccgacgacgaccgagccattggtcgctccaaggcagccgctcagggggctgcttgctcagggcgccggcatctgaagccgccggtcgctgagagggctggttgctgaagcgggctggtcatcgaggcgccgaccgcggaagcgccggcatccgaagccgccggttgcggaaggggccggccgcggaaggggccgccgacctcaccggctcgggatcagggaaccgacgaaccgggccggagcaggtgtgagccgccccgattccggtcaggtagccggaacaggcggcagccagtcaacccgagaggcgaagctggtagtcgtacggcggagcgtgtgagccggtcatctgccttggtcgggcatcccgcagagagcccgcgcgcgtgcacaccgcgccggcggcgaagggagacgcggcgagatggccccccaatactgggtgctggtagtagcgatcgtcgtgctcgccgtgtcggtgatcgtcggcttgaccctgggcgcccgtgcgctgggtcagctgcggaccgaacggcaggacgcccacgaccggcaggagcaggaggtcggtgtcgcgcaggcgaaggtcgccgacgccaatgccaaggccgcttcggtgcgtgccgaggccgccgccgcgaaagccgaggccgccgccgcccgggccgaggcccgccgggtgctggagaacgcgcacagcgaagccgacaccatcctggagcacgcccaccgccaggccgaggcggatgtggagcagctgcgcaccgcggcccggcggtccggggagcgggagatcgcgctgctcaacgccacggtgaaggagcaggccgcggaggtggagcggcgggctgcccggatcgacgagcgggagcggctgcacggcgaggaggtggagcgcctggtggagcgggagcgccggctcgtcgccctggagtcggagctggcgaagcgggaggcgaccttgaaggcccgggagacggaggtcgaggcggcggagaacaccaagcgccgcgagctggagcggatcgccgggctgaccacggagaccgcgaagggcgagctgatcgacgcgatcgagggtcaggcgaagcgggaggccgccatcctgatccgggacatcgagcaggatgcgcggagcaccgcggacacccgggcccggcacatcgtggtcgacgcgatccagcggatcgccagcgagcagaccgcggagagcgtggtcagcgtgctgcacctgccgagtgacgagatgaagggccggatcatcggccgcgagggccgcaacatccgggccttcgagtcgaccaccggggtcaacctgatcatcgacgacaccccggaggcggtgctgctctcctgtttcgacccggtgcgccgcgaggtgggccggttgacgctggagaagttggtgctggacggccggatccacccgcaccggatcgaggaggtcttcgacagcgccaagaacgaggtggagcggctctgcgaccgggccgccgaggaggcgctggtcgacgtcgggatcaccaacatccacccggagctggtgaagctgctgggccggctgcgataccggacgagttacggccagaatgtgctcaagcacctggtggagaccgcgcacatcgccgggatcatggcggccgagctgggtctggacgtgccgatcatgaagcgggcggcgttcctgcacgacatcggcaaggcactcacccacgaggtggagggcagtcacgcgctgatcggcgcggatgtggcccgcaagtacggcgagcacgaggagatcgtccacgccatcgaggctcatcacaacgaggtgccgccgcagaccatcgaggcggtgctcacccaggcttcggacgcctgttccggcggccggccgggagcgcggcgggagagcttggaggcgtacgtcaagcgcctggagcggatcgaggagatcgccggcggcaagctgggcgtcgagaaggtgttcgcgatgcaggccggccgggagatccgggtgatggtccgccccgacgacatcgacgacatcggtgcggcggtcctggcccgcgacgtcgccaagcagatcgaggaggaactcacctaccccggtcagatccgcgtcaccgtcgtccgcgagtcccgggtcaccgagttggctcgctgatctcccgcggttcctgaccgtgcgagcgcggtcgatggcggcggggaggggcctttgtgcggccccgacgaccgtcggtcaggcggttccgccggcgccttcggcttgggcgatcagcgctgccgtcggcggctgccggcgcggcatgccggcggtcttgcgaccgcgggaaaggcgccgctggacgtattgagccagcttggagagggagtagttgaccaggatgaagagcgtcccgatcacggcgtacacctggatggggttgctcagcacgccgatgatctgcttaccgatgttcagggtctcctcgtagctgatgatgaacccgagggaggtgtccttgagcaccacgacaagctggctgatcagggcgggcagcatgatccggaaagcctgcgggagcagcacgatcatggtggtctgcggcgaggagaggccgatcgcggcggccgcctcccgctgtccgggtggcaggccggtcatgccggagcgcaggatctcgccgatgaccaccgagttgtagatcgtcaggccgatcacgagataccagagggtgtccatgctgacaccgaactcgggcaggccccgcgccacgaagaagatggtgaggactacgggcagcccgcggaagacctcgatgcagatccgggtcgcccacgcgagcgccacgctgagcgcgcgcaacaggagagcgacgggggcggcgatgccggggaagcggcgccgggccagcgactcgagttcgatccgcagcacgctcagcagcgtcccgatgatcagggagccgatgatggcgaacaccgcggcggtcagcgtgttcttgaccccgacgccgatgcggtcccacacggcgctgaaatcctcgttgccggggtcgatgagcggaccccagagcttcatcgagaattgccccttgtggtgcaggggcagatagatcagatagtagattccggccagcagcccgatcgcgacgagcaggctggagatcagcgtgatgcggcgctggcgggggcccggaacgtcgtagagaacgctctgctgactcacggggtcacctctgtcgcgccgcggtgccaccgaccggtgacaccgatgcccatcgggtcattgccgagcctgctcatcgggcggtcaccgcctgcctgcgttcgatccggtcgagaagggcgcccaggggcacagtcatgatcagatatccgatcgagacgccgatggcgacgggtacgaaggcgaggccctccgccgaggtgagctggtcggcggtctgtgacaggtcgccgacgacgccgaagaaaccgatcagcgcggagttcttgatcattgcgatgatcaccgaaccgagcggcacgatggacgccttccaggactgcggcagaacgacgtaccgcaggttctgaccgaatgtcatgcccagcgaccgggcggcctcggattgcccgggctgcaccgcgttgacaccggagcgcagcgcctcgcagacgaaagcggcggtgtagagcaccagcgcgatcagggcgaagcgaaagtacggcaggtcggtgccgagccgggtgaagatcgcgtcgagcaccggaatgcggaggaagtcggcgttcgagccgagagccggcagggcgaacgcggcgaagaacatgaccacggtcagcggcatgttccggaagacggtgacatacgcggtgcccagcgcccgcagcggcgggacgggggagatgcggagcaccgccacgacggcgcccaggaacagggcgccgatcgcggcgagcacgcagatctggagcgtgagccagaagccgcccgcgaagacgtcgaatcgatcgaagatcacactcacgggccgggcttcctcctcgtcaccggatcagtgggcggaaatcagtagcggttgaccgtcggcgcggcacccagttcggcgccgaacttgccggcggtgtcgtcccaggccttcttccagctgccgtcggcgaacgacttctccagcgtgtcgttgatgaacgtccggaagtccttgtcctccagcttcacgccgatgccgtacggctccttggtgaagttgggcccggccagcttgtacttgccctggttcttcgagatgtagcccagcaggatcacgttgtccgtggtcaccgcattgacctggccaccgtcgagggcggcgatgcacttgtcgtaggtgtcgaagagcaccacctggctggggacgtctttgacgtacgtcttgatcttctcggccggcgtcgagccggtgaccgagcagaccttcttggtgccgtccttgaaggagtccggcccggtgatggtcgagtcgtctgccttgaccaggatgttctggccggcctcgtagtacggcccggcgaacgcgacccgcttcttgcgctcgtcgttgatcgtgtacgtggcgaccacgaagtcgaccgtgttgttcacgatcgagtcctcacggaccttcgacggtgtctcgacgtactggatcttgtcggccggaatccccagttccttgacgatgatcttggagatctcgacgtcgaagccctccggtttgccggacagtcctttcagcccgaagccgggctggtcgaacttggtgccgaccttgatcgtctgggccttgttgagacgctccatcgtgctacccgcggggaacgacttgctgccggcacccgacttggagcccccgtcggatttgtcgccgcacgcggccaggccgaataccagggcggtagccgtggcaacagccgcgagacgctgcaaacgcatggtcctcttctccttgttagatcgaaccgctgaacagtcttgggggcggtctgtgaggtggatcagtgcgtcaggatcttggaaaggaagtcgcgcgcccgctcgctcttcggattggcgaagaactcggcgggtgtcgcctgctcgaccagctggccgtcggccatgaagaccacccggttcgccgcgtgccgggcgaagcccatctcgtgggtgaccaccaccatggtcatcccctcccgggccagggcggtcatcacgtccagcacctcgccgaccatctccgggtcgagcgcgctggtcggctcgtcgaagagcaacgccttgggctgcatggccagcgcccgggcgatcgcgacccgctgctgctggccgccggagagctgggccgggaacttgtccgcctgggcggcgatgccgacccggtcgagcagcgccatcgcgcgctcccgggcggcggccggtttctccttgcggaccttgaccgggccgagcatcacgttctgcacgatggtcttgtgcgcgaacaggttgaacgactggaagaccatgccgacctcgctgcgcagccgggccagcgcccggccctcggcgggcagcggctgaccgtcgaaggtgatcgagccggagtcgatcggctccagccggttgatcgcccggcacagcgtcgacttgcccgaaccggacggtccgatgacgacgacgacctcgccccgctcgaccgacagatcaacatctttcagcacgtgcagcgggccgaaccacttgttcacgttctccagaacgatgagagcctcgcctgccaccccgtgtccatccgctcgtcggtcactcgatgggtgccaccttagggggacacaggtatcggaatgcgacgagaatggtcacggagcggtaacgcagccggcgcggggcgaaagggacgtagaccatgacgggtatggctggcctctggaactggtccgccgccgggctgatcgagcccgagcgcgtgcggaacgccctggctggagcgttggaaaccccggtgggggagatcgccggggggggcttcggcggcctgctctgcgacgtttatcaggtcggtggcgattttccgacactgatcgatgtattcctggccccgggccacctcgccgaggagacgatcgccagcgcggtcgcggttcggctgggcgccgcgctgctgctgcccgacgacaccctcaacccgacccggtacgtgctggccgagccggacgggacgctgcgcgccgtgcacgtcgaggaggaggagaccgacgacggtgtcgaacggcggcatgcccgcccgtgcaccggcgccgacccggactgcgccaccggcccgggttgcgcccgctcccggttccgggccgcggcctgaccgcagtaccctggtcaattgccatgactaccgagatgcagagcagttccgggatgcccagcgccgcgcgcacctatgatgtgcgcacctacggctgccagatgaacgtgcacgacagcgagcggatctccgggctgatggaggacgcgggctacgtgcgcgccgctgacgccgacgccgccgacgtggtggtcttcaacacctgcgcggtccgggagaacgccgacaaccgcctctacggcaacctgggccacctgcgtcccacgaagctgaagaaccccggcatgcagatcgccgtcggcggctgcctggcgcagaaggatcagggcgacatcgtcaagaaggcgccctgggtcgacgtggtcttcggcacccacaacatcggctcgctgccggccctgctggagcgtgcccggcacaacgagcaggcgcaggtggagatcctcgagtcgctcgaggtgttcccgtcgacgctgccgaccaagcgggagtcgacctacgccggctgggtgtcgatctcggtgggctgcaacaacacctgcacgttctgcatcgtgccgtcgctgcgcggcaaggagaaggaccgccgcccgggcgacgtgctggccgaggtccgcgcgctggtcgccgagggcgtcctcgaggtcaccctgctcgggcagaacgtgaactcgtacggcgtcgagttcggtgacaagctcgccttcggcaagctgctgcgcgcctgcggtgacgtcgagggcctggagcgggtccggttcaccagtccgcatccgaaggacttcaccgacgacgtgatcgccgcgatggccgagacgccgaacgtctgccactcgctgcacatgccgctgcagtccggctcggaccgggtgctcaaggcgatgcgccgtagctaccgccaggagaaatacctggacatcatcgacaaggtgcgggccgcgatgccggacgccgcgatcacgacggacatcatcgtcggcttccccggcgagaccgacgaggacttcgagcagaccctcgaggtggtccgccgggcccgcttctccagcgccttcaccttccagtactcgaagcgtcccggcaccccggccgccacgatggcggagcaggtgccgaagaaggtggtccaggagcgctacgagcgcctgatcgccaccctcgaggagatcacctgggcggagaacgggaaactggtcggcgagaccgtcgaggtgctggtcgcggtcggcgagggtcgcaaggacgagcgcaccggccggatgagcggccgggcccgggacggccgcctggtccacttcgcgaccggcgacctcagcccgcgcccgggcgacatcgtcgagacggtgatcacctacgccgcgccgcaccacctcaacgccgacggcgcgccgctctcgcaccgccgcacccgggccggcgacgccgccgaggcgggcaccacgccgaagctcaagggcgtctcactgggcctgccgacgatcggtgtcccggcgccgctgccggccgccgagggctgcgccctctaaggttctcgaccggctacccgctacccccgacggccatgatccgcgggacggatcctggccctttcccggtccacgcgcggccaggtcgtcccgcgatcgtgcaacctggccgccgccctcgccggtctatccggacgtgagagcagacagaggctcgggtaacaccgagcgtgacagccagttcgccggcttcgtggccgagcaacgcggccggatggtgtacaccgcgcggttgctgaccgccggtgacgcctttctcgccgaggatctcgtgcagaccgcgctgacgaagctctacgtctcgtgggcggccttcgggcgggccgacagcccggacgcctacgtgcggcgggccctcttcaacgcgctggtcgacgagcgcaaacggatctggcggcggcacgagcggccggtcgcggacgtcccggaccgggccggcgagctcgtcggcgcggacgacggcgatccggaactggcccgggcgctcggcgaactgcccccgcggatgcgcgcggcggtcgtctttcggttcgtccacgacatggacgtggccgagacggcccgggcgctgggctgctcagccggcacggtgaagagccagacggcccgggctctcgacaaactgcgtgccgcgctggggcagcccgccctcgcgaccaccttctccggccaaccacagggagccagctgatcatggacctgcacaccagactcgagcgcttcggcggcccgatcgaggccgccgccgcggacaccatcgccgccgacgtggaacgcgggcagcgcgccctgcgccgtcgccgcaccttccggaccagcgcggtgaccgcgttcgggatggccgcgatcgtcgccaccatctcggtgaccggtgcggtcaccggcaccgcgccgtccgggccggccgtcgccgccagcctgccggccgccgccgggagcacgcccgccgcccgcgtcaagctggtcgactacaccggcgcgcagccgaagtggttcaccatcgacaaggtgccggagggctacttcgtccagaaggacgacgagggcggtctgacgatcgccccggcatcggtcaagaatccgccgccgggcgccgacccgtcgaaggatccgcggtacgacccgagcgtgctgaccgacaagatcggcatctatctggagccgacctggtaccgggagggcaacgacgacggcgagaaggtgacggtcggcgggttcccggcggtcctgcacggcgccgccccgctgcagcagctgatgatcctggtgtcgccgaaggtctacgccaccgtccaggcggatgtcccgctgacccgggaccagctcctggagctcggtgccggcctgcacgtgagcaaagaggccgtcgaccggatggccgcatcgaccggcaagaccggcaagaccggcaagtgacggtctgaccggtcaccacccgctgcggcccggccgcggtccgctcgcggtccgcggccggttcaggttcccgatcgacgcgtacgcgggtagcccggccgccgcccgcagatgacccagcagcgcggtggtgccgggcgggtccggcgtgtccccgtacaccgccgcgtagacggtgcgggcggtatcgggcagtgccaccgtccgtacgcccggatcctggtgtgcggccaacgccagcgcgggcaggaccgtgacgccgagaccggccgcgaccagcgcctgcaccgcgacgtagtcgtcggtggtgaaacggatgtccggggtgaagccggccgccgcgcagacccgcagcagctccgcccggcagcgctcgcagccgctgatccacggccggtcccgatggtcggcgagggtgtccccggcccggtcgccgggcgtcaccagatacagccgctcttcgagcagcggctcgggccgcagcccgtccaggtccggcaccgtctccccgggataggtgaacagcagcgccacctccacctcgccgctgcgcagcagccgcaccgcggcgggcggctcggcctcggtgaagcgcaggtcgatcccggggtgcgcgccgacgaacccggccgccgcggccggcacgaaggtccccagcgcgctggggaaggcggccagccgcacccgcccggaccgcagcccggtgtgcgccgccagctccgcctcggccgcgtcgagccggcccaggatctcctcggcgcgctcggccagcatccgcccggcgtcggtgaggcggatgccgcgcccggcccgctggatcagccggctgccggtctccgcctccagccgggccaggtggtggctgaccgagggctgggcgtagtgcagggcctgcgcggccgcggtcaccgacccgcaccgggccacggcgaccagcacccgcagccgggtcacgtcgagcacaccggcaatctatcaaccggatctatgagacatcgagcgatccggcattggaccgatgcgttgccgcgcccgaggatcgacgcatggagctgaccctcgccgacttccgcgccgcccacgccgtcgtccgccgccacctggcgcccaccccgctcggcggctacccgctgctggaccgggcggccggcgcgaccgtgctggtcaagcacgagaacgcgcagccggtcggcgcgttcaaggtgcgcggcggactgaccctgctggacgccctgccggccgccgaccgggcccgcgggacgctcacctggtcgaccgggaaccacgcgcagtcgctggcctacgccagccaccggtacggcgtgccctgcacggtggtgatgccggccggcaccgatccgggccgggccgccgcggtcgaggcgtggggcgcccgcgtggtgctggccggcgaccgcctggaggacgcccaggagcacgccggcaagctggccgcggagaccggcgcccttgcggtcagccccggggacacgcccgagctgctggccggggtcggcaccctgtacctggagattctggagcgggaaccggacctggacgcgatcgtggttccggtcggcagcggcaccggggcggccgcggcctgcctggtgagcgcggccctgggcgcgcgctgcgcggtgatcggcgtgcagtcggccgcctcaccggccgcacacgactcgtggcgggccggcgagttgctcgcccggcccaaccggtccacggtggccggcctggccaccgggcgcggctacgcgctgccgcagcgggtgatgcgggccggcctggccgatttcctgctggtcggtgacgacgagatcggggcggcccgacgactgctggcgagcgccgcgcacaccctggccgagggggccggcgcggccgcgctggccggggtgttgagccggcccgacctgttcgccgggcgccggatcgcggtggtctgcagtggaggcaacgccgaccgcgccgaactgggcacgatgatcgatggccgagggtgaagatgccatgacagactgagggccgtctacgtcccgcagaggtcagaggtgtggatggccaacttcccgcgcgcgccgctgtcgtcgtggggtgagcagcaccagcccgcggtgacgttgacgcgtgtggtgttcgccctgatcggcgcggccgccctgatgctcggctacgccggcctcgacgactatctggccaccgccccggcgggcagtcgggacccgctgaacctggcgtacgacacgatgcagctgttcgtgctgggctccgatccgctgcagggcggcacccgcttcccggtcgcgctgcagatcgcccggttcgccgcgccgctggtcacgctgtacgcggtcgtcgagggcggccgcctgctcctggccaccgaggtgcgccgctggcgggctcgccgctcccgggaccacgtggtggtctgcggtgacacctcggtggcccgcaccctggccgagcggctgcaccgggccggacgccgggtggtgctggtccgcacccggccgatcggcccgctggagctgcgcggccgcggcctgctcggcgtgcagggcgacgcccgcgagccggaggtgctgcgcggggcggcggccgggcgggccgcggtgatctactgctgcgccgagtccagcgcggtcaacctggcgatcgccgcgaacgccgcccgggtggccggcgacggtcaccgcgacctggccatctacgcccagatccacgagccggactgggcgctcaccctgcaggcccggcggctcggcgtgcccgacgcgggggcgcagcggctcgacttcttccagatcgaccagctggccgtgcaggtgctgctggcccggcagccgctgccggtccggctcggcggcgccgcgccgcggctgctgctggccggtgactcaccgctggtccgggcgctgctggtggaggtggcccggcactggcggctgcgccggggccggccggaccggcggctcgacatcgacctcgtcgcgccggacgccacccgggtgctggagcgggtcgcccggcggcacaccgttctgcgcgacacgtgccgggtcgtgccccgggagacgaccgtcgccgaactgctcgccggcgccccggccgacgcgtcgcgctacgagcgggcgttcctcttcttcgccgacgagaagtacgggctgcagctcgccctgaccgaataccggctctggcaccgggtcgccggcgacgtggtggtggccgtggacggcctggccgagttggccgacgcgttcagcccggaacacccgccgccgctgctggacccgctgaacgggcggctcaagctgttctcgccggccgcggcggggtgcgatccgacgctgatcgccgaggacctggccgagcggctggcccgactgatccatgagcggtacgtggtggcccggctcgcccgcggggatcggcgaggcgacgggctcggcgatccgtccggtgggcatccggcgatgaccgcgtgggccgatctgccggaaccgctgcgccgggcgaaccggctgcaggccgccgacatcggcccgaaactgcaccaggcgcactgcgcgatcgtgccgcgggacggtgccgcggacgatttcgcgttcaccgcggcggaggtcgaggagctggcgaagcgggagtcgcggcgatgggtcgaggcgaccctggccgaggcgcgggcccgggaggtaccaccggccgaacgaaacgtcccctttttgggggaatgggagcagcttccggccgaagggcaggagcgctgccgtagggcaattcgcgacattccggaaattctgggcgaggcgggcttccaagtcgtccgtttgtcggacactggagccgaccgggcactcttcccggcatgaacggactaatagggcatatggccgtcaagggggcacgatgattcgcatcggggtgacgggccacatcgggctcgaccggtcttcgcgccggccgatccgcaacgcgatcgtggccgaactgcgcaaacacaagccgatccacggggtcacctgcctcgccgacggcgcggaccggatcttcgtggaagcggtccggatctgccgcggcaccttcgaggcggtgctcccggtgccggagataagcgccgaaccggaagaagaccgggaactgcgcgaactcatccggtacgctaccgacgtcacccggctcaccgtgcccggcgcgccggagctcacctacgaggccgccagccgggaagtggtcgaacgcagcgacctgctgctcgcggtctgggacggcacgcaggccggggcgcgcggcggcaccgcggaaaccgtcgccttcgccagggaacagggcaaacaggtgcaccggatctggccggacggcgcgcgccgggtcgccgtcacctcagccgtcccggtctccgcctgagacgggatcagccgtccctggcctgcctgagacgggatcagccgtcccggtccccgcctgggacggatcagccatcccggtctccgcctgagacgggaccgggtggagcgggcggcaggtcggtgacccaccgccccccacctcagttggcctgctcggccagcgccaggaactgcttcttcgaggcgagcgcctgctcggcctccttgatccgccggttgtcgccggccgcccgggcccgctccagccgctgctcggcctcggcgacctggtcgcgcatctgacgcagcagcgggttgtcctgcgggctggtcttgcgccacgccgagtccatcgccacccggatccgctcctcggcggcccgccagcggcggtccagcccggccgcggcctcccgcggcacccggccggcgtcgtgccacgcggcctgcgcgtcgcggagccggttctgcgcgccgcgcggatcggcgtccacgtcgaccgcctcgatctcggccaggatcgcctgcttgcgctccaggttgccctggtactccgcgtcgcgggcggagaagacctcactgcgccgggtgaagaacgcgtcctgcgcggcccggaaccgctcccagaggcgctgctcggcctccttggcggcgcgcggcgcggccttccactcggtcatcagctccttcagccggttcgccgtgctcgaccactcggtcgaagcggccagcgactcggcctcggtgaccagctcctccttggcggtctgcgcctgcttgcgctgcccgtccagggtggcgaagtgcgcgccacgacgccgggtgaaaccgtcccgggcggcggcgaaccgcttccacagctcaccgtcggtcttcttgtcgacgccgcggatcgtcttccactcgtcgaggatctccttgagccggtcaccggccgacttccacccggtggcgtcggcggcgatcttctccgcctcctcgaccagggcggtcttgcgggccagcgcctcggtgcgggcgacctcgcgggcggccttggcctcgctcgccttctcgtcggccagcgcggaaagtttctccagccgggcggtgagaccgtcgatgtcgccgaccacgtgcgcctcgtcgagctgggtgcgcagccgcttgacactggtcagtgagtgggacgcgtcggccgcgcccgacttgaggcgagcctcgacgaggtcgacctcggtcaccaggtcctcgaaacgacgggcgaagtgggcgaggccctcctccggcgtcccggcctgccatgagccgaccacccggtcgccctcggcggtcttcacgtacacggtgccgtcggcatccacgcgtccgaaggccgtccagtcctcgttcatgagctcatcctcgttctcccggcgccgccggaccactccggtccccggccaccgccacagcgcagtggagtgccaaccttctcagtggcattctttctcgcgcattgtcacaggtccaacccggttaggggaaagctcccgcccgcgaccgttgcacaaccttgtcctacggttgctccgtgccctccagtcccggtccccgcgtggtcaccgtcgtcgggccgacggcggccggcaagtccgcgttgagcatcgcactcgcccacgaactcggcggcgaagtggtcaacgccgactcgatgcagctgtatcgcgggatggacatcggcaccgcgaaactgggcgccgccgagcgcgacggggtgccgcaccacctgctcgacatctgggacgtcacggtcaccgccgcggtcgccgagtatcaggcgctggcccgcgccgcgatcgacgacatcctggcccgcggccgggtgccgctgctggtcggtggctccgggctgtacgtgcgcgcggtcctggaggaattcgagttccccggcaccgacccggcgatccgcgcccgcctcgaagccgaacttgccgcgaccggcccggcaccgctgttcacccggctcggcgtgctcgacccggtcgcggccggccggatcctgccgtccaacggccgccgcatcgtccgcgccctcgaggtcatcgagttgaccgggcagccgttcacggcggcgctgcccgacccgaaaccgtattacgacacggtgcagatcggcgtcgaccgggatccggccgagctggacgagcggatcgcccagcgggtcgagctgatgtggtccgccggcctgctcgacgaggtgcgcgcgctggacgcggccgggatccgggatgggcggacggcctcgcgggcgctcggctaccagcaggcgctggccgagatcgacggggtgctgagcggggcgcaggcgcgggccgacacggtgcgcggcacccgccggttcgtccggcggcaacgctcctggttccgccgcgacccgtcgatcacctggctggacggcgccgccccggcactgctggccgacgccttggccgtgatcggctgaccgccggtggtgccgcccggatgtgcctggctgtggtgaccggtggtgcgcgatgatgggcggcgtgtttttcaccaagggccacggcaccgccaacgacttcgtcatcctcgccgaccccgacggcgaactggagctgacgccggcactggtcgccgcgctctgcgaccggcggcgcgggatcggtggcgacggcgtgctgcgcgtggtgcggtccgcgaaacacccggcgggggccgggcacgccaccgaggccgagtggttcatggattactggaacagtgacggctcgatcgccgagatgtgcggcaacggggtccgggtcttcgcccgctatctgaccgctcgtcagctggccacgcccgggcccgcgggcctgccggtcgccacccgcgccggcgtcgtgcacgcggtggtcgacgccgacacgatcagcgtccggatgagcaccccccgggtgtacgcggcgagcaccgcccgggtcggcccgctgaccgtccccgggatcgccgtcgactgcggcaacccgcacctggtctgcgggctgcacgacggggtgacgctgtccggcctggacctgaccaccgccccgggggtcgaccgggcgctgttcgccgccggggtgaacgtcgagttcgtcgagccggtcatcgacccgaccccggacaccgaccgccacgtgcggatgcgggtccacgagcggggctccggcgagacgatgtcctgcggcaccggggccctcgcggtcggcgcggtggccctgcgcgaggccggcctggccaccggctcggtcaccgtcgacgtcctcggcggccgggtcgtgatcaccgccgacgcggccggctcgtggtggctggccggtccggcggtcctggtcgccaccggcgaggtcgacctgtcggcccttccggtcacctgaccgggatcgtcggcaccccgcggcggggtctttccggtgaccacccgcgggcaatgaagggtcgcggtgatcggtcaggacgcgccagcggcctgatcaccgtgacccggccccggcgggagcggcgatcagttatcagcgcggacctacgacatccggatcttgaagttattctgcttctgaggtgcgctttcccggaagagcatgccggcgggaagcgatgccggagcgcgacgggaccccgcgcaccggcattcacccgataccgctcagaagatcccttccggcgcctggtccagctccgactccggggtggccgacgggttcgacggcgccgggacgccgcggaccaccgcgcggatcgcggcggcgaccgccggggtcacgcgcgggtcgaagacgctcgggatgatcaccgtcgggttgagtttgtcttcgccgaccacgtcggcgatggcgcgggccgcggccagggccatctcctcggtgaactcctcggcgctgacgtccagcatgccgcggaacacgccggggaaggccagcacgttgttgatctggttgggctggtcggagcggccggtggcgacgaccgcggcgtgcttgcgggcctcgcgcgggtcgacctccgggtccgggttggccatcgcgaagacgatcgaccgcggcgccatccgggcgatgtcgtcgccggtgagcaggttgggggcggagacgccgatgaagacgtcggcgccgacgatggcaccgggcaggtcgccggagtagttcgcccggttggtgtggtcggccagccactgcatcgactcgttgaggtcgggcatgccgcggtgcagggcgcccttgcggtcgtacgcgatgatgtcgccgacgccctggcgcatcagcagtttcatgatcgcggtgccggccgcgcccgcgccggagaccaccaccttgacgtcctgcatccgcttgccgaccacgcgcagcgcgttggtcagggcggccagcacacagatcgcggtgccgtgctggtcgtcgtggaagaccgggatgtccagctgctccttgaggcgcgcctcgatctcgaagcagcgcggcgcggcgatgtcctccaggttgatcccgccgtacgccggggcgatcgccttgacgatcttgacgatctcgtcggtgtcctgggtgtccagcaccaccggccaggcgtccaccccgccgaaccgcttgaagagcgcggccttgccctccatcaccggcatcgccgcggccgggccgatgttgcccagacccagcaccgccgagccgtcgctgaccacggcgaccgtgttgcgcttgatggtgagccggcgggcgtcggccgggttctccgcgatcgccatgcagacccgcgccacgcccggcgtgtacgcccgggacagctcgtcccggttgcgcagcgcaaccttcgaactgacctcgatcttgccgcccaggtgcagcaggaaggtccggtcggacaccttgcggacgtcgaccccgtcctgctcctccagctgcttgacgacctggtcggcgtgcgccgagtcggcggtgtcgcaggtcaggtcgaccagcacccgggtcgggtcggagtccaccacgtccagggccgtcacgatcgccccggcctcgccgacgcaggtggtgagccggccgatggacgaggcatcggcggtcacggcgatacggatcgtgatcgaaaatcctgcgctcggcaggcgggtggtcaccacggctgtccctccgacgttggtggggtgatcgcacaaattgtcgctcggacggaatgttcgattcctccgcggtggttactagtgagtcagccacggttatgtggatgcggtcgcccgcgtgacatgccacgatcgggcggaggaggtcacttttgcgaaacacgtaccaggctcccgtgctcgacgagccggacctgacgaccggcgatctggagctggaggagcggcactcgctcaggcgggtggccggtctctccaccgagctcaccgacatcaccgaggttgagtatcgccagctgcgactggagcgcgtggtcctggtcggcgtctggaccgagggcagcgtcgaggacgcggacaactcgctgaccgagctggcccagctcgccgagaccgccggctcccaggtcctggagggcctgatccagcggcgccggcagccggacgcggccaccttcatcggccgaggcaaggtcgacgagctgcgcgacgcggtggtggccagcggtgccgacacggtcatctgcgacggcgagctgtccccgtcccagctgcgcaacctggagcagcagatcaaggtgaaggtggtcgaccggaccgcgctgatcctggacatcttcgcccagcacgcgaagagcaaagagggtaaggcccaggtcgagctggcccagctgcaatacctcctgccgcggctgcgcggctggggtgagtcgctgtcccggcagggcggcggcgccggtggcggtggctccggcggcggcggcgtgggcacgcgtggtcccggtgagaccaagctggagaccgaccgccggcggatcaaccagcggatcgcgaaactgcgccgcgagatcaaggcgatgcgcacggcccgggacaccaagcggtcccgccggcaggccagcggcactcccgcggtggcgatcgccggctacaccaacgccggcaagtccagcctgctgaaccgtctgaccgaggccggcgtcctggtggagaacgcgctgttcgccaccctggacccgaccacccggcggacctcggcggaggacgggcgggtctacacactgtccgacacggtggggttcgtccggcacctgccgcaccagatcgtcgaggcgttccgctcgacgctggaggaggtggccgacgccgacctggtggtgcacgtcgtcgacggctcgcacccggacccggagggtcaggtcagcgcggtccgcgaggtgctcggtgaggtcggcgccgaccggatccccgagctgctggtgatcaacaagatggacgccgcggacgaggagaccgtgctgcggctcaagcgcgcctggccggacgcggtgttcgtgtcggcgcgttccgggtcgggcatcagtgagctgagggcggccatcgcggagcggctcccgcgcccgccggtcgacatgcggatcctgctgccgtactcgcgggccgatctggtcgcccgggtgcaccggaccgggcaggtgctgcagtcccggcacctggacgacgggaccgagctgagggtgctcgtcgatgaacggctggcggccgatctggaggagttccgttgctgagagtcacctgtcccggggtgcgaaaagcgacacctatggacctttgaccagggttgatccacgcgttacaccgatgggtgacgccgcatgcgacactgtgcggatgcggcgtctcgtgttctcgatcgttctgggtgtgggcctggtggcgatcggtggcaccggcgcgtctgccgctgatccgacgccgacggcgacggtcagtgccaaggcgacggccggtaagaagatttgtgagatcaagagccctctgctcaacgaggtctccggtctggtcgcgacgaagtcgggattcgtcgccatcaacgacagcacggacgccacccggcgtttcgtcttcttcctggacaccaagtgcgccatccagcggaaggtcagcatcgccctctcccgtgacaccgaggacatgatcctgtcgccggacggcaggacgctctggatcgccgacaccggcgacgacgacgcgctcaagggccagcccgcccggtccaacgtcgggctgtggacgatgccggtgaccggggcgcaagcgccggtgctgcaccggctgagctatccgtcgggggaccagcacgacgccgaggcgctgctgctcgacggtgacggccagccgctgatcgtgagcaaggagatcggcgcggcacacgtctacaagccgtccggcccgctgaaggacaacaacgccaccggcgtgccgatgacccgggtcgccgagctggcgctgccggccaccgagacgccgggcaacgcgttcgcccgggtcttcaacaaggtgatcaccggcggcgcgatggcgcccggcgacggcaaggtggtcctgcgcacctacaccgacgcctgggagtacgacgtcaagggcggcgacgtgctggccgcgctgaagaccaggccccggaccacgggcctgccgaacgagccgttcggcgaggcgatctcgtacagcccggacggcaagacgttctacaccgtctccgacatgaacggcgacgcgaacaccgcgaactggatcatgcagtacgacccggccaccacggtcgccgcgcagtcgaagaaccagtcggacggcaccgcggacgcggcgtggtacacgaagctgagcgtgagccagatcacctacctggtgggcggcgtcggcctgatcggtctgctgctggtcggcgtcggggtgatcgggatcgtccggttccgcaaggcgcacccggccggggtgaccgtggacgacgcggactccgggccgctgggcaaggacgacaacgagctgatcggcgtgggcagtggcgccgggtacggcagcggcaacggcccggtctacggcagtcagccgcgacccggtgtctacggcggccagctagctagctagcgccgcgcggtggtccgcagcagccgcggccgcagggcggcggcgtctacggcggccagccgcagcgtccgcagggcggccaaccccagcgcccgcaaggtgggcagcagcggccccagggcggccagtcgcagcgtccacagggtggccagcagcgacctcagggtggtccgccgcggccgccgcagggcggtggtggtcggccaccgggcggcacctacggtgggcgcccgcaggggccgggcgacggacgtcgctgagagaagggccggcggatgccggcccttctccgttcgcgcggtcagacccggcgcagcacggccaccacgcggcccatgatggtcgcgtcgtcgccggggatcgggtcgaaggccgggttggccggcatcagccagacgtgcccgtcacgctggcggtagctcttcaccgtcgcctcgccgtcgatcatggcggccacgatgtcgccggcctcggcgttgggctgctggcggacgaccacccagtcgccgttgcagatcgccgcgtcgatcatcgagtcgcccttgacctccagcatgaagacctcaccctcgccgaccagctcgcgcggcagcgggaagaagtcctcgaccgcctgctcggcgaggatcgggccgccggccgcgatccggccgaccagcggcacgtaggccggctgcggccgggccgcgcgcagtgcctcgtcgtcgaccagctcaccgggggagcggacgtcgacggcacgcggccggttcgggtcgcggcgcaggtagcccttggtctccagagccttcaactgatacgccacactggacggggagaccaggccgacggcctcgccgatctcccggacgctgggcgggtagccgtatttctcgccccactcgcggatgaactcgaggatccgccgctgccgggtggtgagggcaccggcgaccggctcggcgacgttgttcagcggggtgaccgaacgcagctgcggcgcgtcggccgaacgggcccggctcggtgtgcgccggcgcatggcggccgcggcactgcccgggtcctgcctgatcggttgctgctgtcggctcgtgcggtcgtcggtcgacacgtccgccctccctgtcggccagtgcctgtcggcacgtggtgcgtcgcggagccggatcgcgccgtggggatggcgtttgtccggctgacccctcttgacaggaaaccgtagtaggcgcgcgcgacatattcaaacatctgtacgaggttttaccggcgtgtcgcccgtcaggactggattttagtactcgcgttctgataaaccgtcgtacgggcgttctatcgaacgggtgtccgagagaggggagctgtcatggtggtcaccggtggagctcggcacaccgcgccgccgttgcgcctgacccgccggggccgggtggtccttctcggtctcttcttcgcggtgtcggttctcgcgagcgttgttttgttcacgaccgcgtcccgcggctaatgcgccgcttgctcgtcatgtccggttcgccgccgtgccgggaaacggtttcccgacgcgcccggtgatcgtgccgtcaccccagcgtgttgaggtgcagaatacggcgcgtcggcacgtcacttaacttgcgccggcgtccgcaccggcatagcgtcttccccaacatgtagtggtcacagagatgcacagcatccacaggttgggtttctctccccggatttccacaggttcgttcacagtcccgccgatgtgccatcgcggtgaggctgtgcttcggcgtgtccggggtagcggtgaagggggagatcgcggtgcgttgcccgtactgccggcacgccgattcgcgtgtcgtggactcgcgcgaggccgatgacggtcaactgatccgtcgccgccgctcgtgtcccgagtgcggcaagcggttcaccacggtcgaggaggcggtgctcgcggtggtcaagcgcagtggcgtcaccgagcccttcagccggaccaaggtcatgagtggggtgcgcaaggcctgtcagggccggcccgtcgacgaggactcgatcgcgctgctcgcgcagcgggtggaggaagccgtccgggcccgcggcgccgcggagatcccgagccacgaggtcggtctggcgattctcacgcccctgcgtgaactcgaccaggtcgcctatctgcggttcgccagcgtctacaaggccttcgactctctcgacgagttcgagaaggagatcgccgcgctccgcgaggcgccacccgtccgggacgccgggacgcgacacgccgtcgcgccgcggtccgggacggcccgtgtgcccaggatcaacggctgataacgaagttgtctacgagggggagcacatcagtatggccggagacggcatcaccgcgggtcgccagcgcagccggacgaacacgaacggcggcgacgcggcggcggccgcggggctgcgcgtggagcgggtgtggacgacggcgggcgtccacccgtacgacgaggtggagtgggagcgccgggacgtcgtcatgacgaactggcgggacggctcgatcaacttcgagcagcgtggcgtggagttccccacgtcctggagcgtcaacgccgcgaacatcgtgacgaccaagtacttccgcggcgcggtggggacgcccgagcgggagacgtctctgcgccagctcatcgaccgggtcgtgcagacctaccgccgggccggcgaggagcacggctacttcgcgagcccggccgacgccgaggtcttcgaccacgagctcacctggatgctgctgcaccaggtgttcagcttcaactcgccggtctggttcaacgtcggcaccaagtcgccgcagcaggtcagcgcgtgcttcatcctctccgtggacgactcgatggactccatcctcgagtggtacaaggaggagggcctgatcttcaagggcggctccggctccggggtgaacctgtcccgcatccgctcctccaaggaactgctgtcctccggcggcacggccagcggcccggtcagcttcatgcgcggcgccgacgccagcgccggcaccatcaagtccggcggcgccacccggcgtgccgccaagatggtcatcctcgacgtcgaccacccggacatcgaggagttcgtgcagaccaaggcgcgtgaggaagacaagatccgcgcgctgcgggacgccggcttcgacatggacctgggcggcgccgacatcgtctcggtgcagtaccagaacgccaacaactcggtgcgggtcagcgacgagttcatgcgggcgtacgaggagggcaccgagttcggtctccgtggccgcctcgacggcgaggtcatcgagaccatcgacgccaagaagctgttccgcgacatcgcccgggccgcctgggagtgcgccgaccccggcctgcagtacgacgacaccatcaacgactggcacaccaaccccgagaccggccggatcaccgcgtccaacccgtgctcggagtacatgtcgctggacgactcgtcctgcaacctggcctcgctcaacctgatgaagttcctccgcgccgacggcggcttcgaggtggagaagttcgtcaagagcgtcgagttcatcatcaccgcgatggacatctcgatctgtttcgccgacttcccgaccgagaagatcggggtcaccacccgggcctaccggcagctcggcatcggctacgccaacctcggcgcgctgctgatggcctccggcctgccctacgactccgacggtggccgcagcgtcgccgcggcgatcacctcgctgatgaccggcaccgcgtaccgccgctcggccgagctggccggcgtggtcggcgcctacgacggctacgcccgcaacgccgacgcgcaccagcgcgtgatgcgcaagcacgccgctgccaacgacgaggtccgcgcccagggcccggtcgccaccgagatcctccgtgaggccacccggcagtggaagaacggcaacaagatcggtgagaagaacggctggcgcaacgcgcaggcgtcggtgctcgccccgaccggcaccatcggcctgatgatggactgcgacaccaccggcatcgagcccgacctggccctggtcaagttcaagaagctggtcggcggcggctcgatgcagatcgtcaaccagaccgtgccgcgcgcgctgcgcagcctcggctatcccgaggagcaggtcgaggcgatcgtcgagcacatctccgagcacggcaacgtggtggacgcgcccggcctcaagccggagcactacgcggtcttcgactgcgccatgggcgagcggtcgatcgccccgatcggtcacgtccggatgatggccgcggtgcagccgttcatctccggcgccatctccaagaccgtcaacatgccggagacggcgacgatcgaggagatcgaggagatccactaccagggctggaagctcggcctgaaggcgctcgcgatctaccgcgacaactgcaaggtcggccagccgctgtcggccggcaagaccgcgaaggccgccgcgcccgccacggtcgaggccccggccgcggtcgagaaggtcgtggagaaggtggtcgagtaccgcccgatccgcaagcggctgccgaagaagcgcccgtccgagacggtctccttctcggtcggcggcgccgagggctacctcaccgcgtcgtcctacccggacgacggcctcggcgaggtcttcctgaagatgtcgaagcagggctccaccctggccggtgtgatggacgccttctcggtcgccatctcgataggcctgcagtacggcgtcccgctggagacgtacgtcagcaagttcaccaacatgcgcttcgagccggccggcatgaccgacgacccggacgtgcgcatggcgtcgtcggtgatggactacatcttccgtcgcctggcgctggacttcctcgactacgacacccgcgccgagctgggcatcttcaccgccaaggagcgcaccgcccaggcgcaggccgaggccgccgccgaggctgccacggtcgacctggccggcatggcggcgtccgctccggccgcgccggcggtcgctccggccgcgacgcccggcacgtccaccgtgacggtcgccgaggcgaaggccgccacgccggtctcggccggctcgtcgaccgaactgctggagatcaagaccgggcacgccgccgacgcgccgctctgcttcacctgcggcacgaagatgcgccgcgccggcagctgctacgtctgcgagggttgcggctcgacctccggctgcagctgatcagttctccccggacgggcggtgcgctttcgcgtaccgcccgttctgcttgcggtccgctccgacgcgcgcggtccggtccgtggccggcttccggtccgccttctccctgcggttcgttggtgcctgcggtgcgtcgattgcggggtacgccgtggtcagcggccgccgtgggtctcgcggagccagacgccgaactccaccgccgtgcggacgccgtggtcgacgacggcggtggtgatgtcgaagccgttgacctcggcgggatattccgggcgctggtgccagagctgcttgatcgccaggatcgcctgacgctcctcgtcggtgagccgggtggcgaggtcgcggtgccaatcggcggtcgagggatggccgtcgtgcagccagatggacaggtcgacacgccactcgcccagcgtgatggtgacctggtaacgctgatcggccggtttggcgtcgcgctcgtcgcgatagtcgaaaccggtcacgccggggatggcgaccgccctgccgagcagcgtgaggacgtcggccggggtgaagtccggaccgccgaacagcgtgacgtcgaggtcgcgccagaccatcaggccggacacgtagctgccggtcggggtgagtggtcccagcggctccagcagcgcgagcacggaacgtgcctccgcctgcagttcctcgggccggcccatgtcgccctccttccgtatcgatcgacgggcgcgctttgtcgccgatgcccattgtgggacgtgcccggaacggggccgatgaccggtacggctttaacgtgtaagttgaggtgatgagcagcgtcgacgtcctgcccgcccgggttgccaccgccaggatcgccgtcggggtgacgttcgcgatgaacgggttggcgctcgccgggtggctgtcccgggctcccgcggtccgggacgggctggagttgtcggtcgccgggttcggcctgctgctgctctgcatgtcgggcacgtcggtcgcgtcgatcccgctggccggtccgctggtgcagcgggtcgggccggcccgggcggtgctgctggccagcatggcgatggcggccggtctggccgtgctggccaccgccaccctgctcggctcggtggtgctcgccggggtcgccctgctgttctgcggtttcggcaccagcacgtgggatgtcgcgatgaacgtcgaggccgccgacgtcgaacgccgcctcggccggaccatcatgccccgcttccacgccggtttcagcctgggcacggtcgccggcgccggtgtcggtgcggccgcgtcggccaccggggtgccgatcggagcccagctgtacgtgaccacggtgatcgtcgtcgcggtccagatcgccgtggtccgccgtttcctgccacactcgggtccggagccgggcagccggccggcgatgaccgccgggcaggcttggcgggaaccccgcaccctgctgatcggcctgatcctgctcggtttcggcttcaccgagggcagcgccaacgactggctggcgatcagcctggtcgacggctaccacaccggcgacacgctgggcgccctgggcttcggcgtcttcgtcaccgcgatgaccctgggccgcatgtacggcggcctggccaccgaccgctggggccgggtcccgtccctgcgcctcaccgccctgtccgccgcggccggcatcctgctggtcgtcttcggcggctcggtatggctggccctggccggcgccctctgctggggagtcggcgcctccctcggcttcccgatcgggatgagcgccgccgccgacgacccgatccgcgccgccatgcgagtgtccgtggccggctccgtcggctacgccgccttcctggccggcccacccttgatcggcttcctggccgaacacttcggcgtccgcaacgccctcctctgcgtcttcgccgccctcctcctcggcctcaccgcctcccacgccgccaagccacttcccaccagctgacccgtcctttggccgtccccgctccgcgtcccgccgtcaggctggtctcgtttcgcgtttcgccgtcaggccacgcttgctccgtgttctgctggcaggctggtctcgctccgtctcccaagctctggccgctctcgctccgcgtcccagcgtcaagccgtcggccgtgccttgcccggcggcccgccgtcaggccgccgtagcacctttcccgccgtcgaaccgttcgcagcaccttccccgccgccggccgcagccgaatgccccggcgtcgtcgtcccgagtcgacgccccgagccgccgccctgcgtcgacgccccgagccgccgccctgcgtcgacgccccgagccgccgccctgcgtcgtcgtcccgccctgcgccgtggcctccgtttcgcttcgcgtccaaggaatccgcggtccaggagcgagctgctgaaccgcaccgcatcgtcggaccgtgccccgtccgtcgggcgcgccatcgcctcgttcgggtgtgctgccgcgcggcctcctccccgaggcctgagcgccagcggttgggtaggcgttggtgcagagccctggacgcagagcatcgagtcgcgagcccgggcaccgcgcttccggccggagcggtgtgtccggagcggtggatgcgcagcggtgccggcaagggccggtgagcggtcagcgggcctccgcgagaaaggtggtgatcagggtggcgagcgcctcgggctgttcgatcaccatggcgtgcgaggcgtcggccagcgcgacgtggcgcaggtgggggatggcctcggcctgggccagcacgtagcggcggtgggccgcgtacaggtcggcgaacggctcctgctcgggcaggtcacgggtggccagaaccagcagcgacgggcacttggtggcggcgtggaccggggccaggtccagctcggtcatcagggcgcgcagctgggtggtggtggcgaaggacggccggaaggtggtggtgccgtccttgccgtggaccaggttgcggcggaaaccctcgatccacaccttctcgttggcgccgcggtcccgggccgccatccgctggcgctcgaccaggtcggccagttcgccggcttcgacggtctgaccggcggcggcctcgaccatgtcgaagacgccggtgagccgctccagctcggcggcggcccggtccggggtgaggccgggcagctggtcggggcgggtgggcggcggactgccgtccagattcaccacaccgggggactccgggtgccgctgaccccagagcgtggccagcatgccgccgagcgaatggccggcgatcgccggccgctccagctccagctcgacgcagaccgcggccaggtcgccgagcgcggcatcccaggtccacggaccgtccgcggaccgtccgtgcccgcgcagatcgacggtgaccacccggtggtgcgggcgcaacgcccgggcgaggagggtcatgtgggcgaggttgccgccggccccgtgcagcaggagcagtggcggatggtcgcccccgaagtcccgaaccgcgagctgcacaccgcccgcgtccaccaggctgtcgttgatcattgcgtttcctcgttccccgtcggttcggcgtcggtcaggtcgtcggagtcaccgctcgccgcggagaagaagccgctcggatgaacgaagtccaccgatggcgccggaacccggtgggccgcccccgcggaagtggcaccggacgcggtgagcggggctgcggtggccggggtggtgaagggggtggcggcgaggaggcgggcgcggacggcgccgaccggaacgccgccgtccgggtctcggggcagccggccgcgccggaccaggtcgtggatggcctggcgggtgatgccgagcatggcgccggccgtcgcgtaggagaccgtcgtcgcgaacgggtgacccatcctgcggaccaccgcctgcccgagcggtgtccgccaccactccaccggtggggcgaacgcgtgatcgtccgggtagagggtggcgatcaggcgggcgatgatgtgcaccgcctcggcctcctcgccctgctcgatcatcgcggcccactcccacgcccgcacctgcaggcggcggcggacgcggtccacgccgggatccccctccagcaggatctccagcggatcgaccagccggatgtcgagcaagcggatgatctgctcggcgagcaacatacttgaagtctccgccccttgacgcctctcgtcaagaaaaacttgacaccgactgtcaaggatgccgcaggtgaagggaccggcaacggtaccttcactgtccgtacgccactttcctcatccgcccgcggggcaataaggtgtcccgcgaacccgggaggattactggtgcgcacggttctagccgcgctcggcgtcgtcacactgctcgccgccgcgggctgcaagaagcaggacacggacgccccggtctcgttgccgccggtcaccatcgtggagcagccggcggcttccgcgggcggcgcctgcatcctctgggattgggcgttcatccagcagaagatcggggtccggttctcggtcgccgccgccgaccaggtggatgacacgtccacctgcgtggtgcagacggtcgacggctcctggcccgacctgtcactgtcggtggtcgaggagacgaaggcggatgccaaggtgttcctggccaaccgcgtaccgaagaagggtgtgaagctgaagggcctcggcaaggcgggctatcggctgaccggtccggcggccgacgggcacggcccgacggtggagatcggctggttgagcgaggcggagcagttgcagacgctgcggttcaccttcgagaagggtgcggcgagctcgtcggtcaccgcgatgaacgacaggctgctggagctcgcgaaggcgatggacaccaccgacggctagggcggaccggggtcagcgggcggcgacgaacacccgggatgccacctcacgcggcagcctgatcttgtcgccggccttgtcgatggtgaccccgtcccgttcctgcgcgacggtcaccgtcgtgcccgggtcgatcccggcggcgtgcagctgccgcagcacgtcggagttggtctgcacgctttcgcagatccgccggaccacgacgctgccggtcagcccggggaaggccaggttgcgttcgccggggccgggctgttccagggtcgcgtcgtcctcgggcaggccgagttgttccaggccggggatcgggttgccgtacggcgaccgggtcggcttgttgagcagctcatagacccggcgttcgacggagtcgctcatcacgtgctcccaccggcaggcctcctcgtgggcttcctcccacggcatgccgatgacgttgaccagcagcagctcggccagccggtgcttgcgcatgaccgacacggcggtgctgcggccctgctcggtcagcaccaggtggcggtcgccctcgacggtgagcaggccgtcgcgttccatccgggccacggtctgactcacggtgggaccgctctggtgcaggcgctcggcgatccgcgcgcgcagcgggggcacgccttcttcctcgagttcgaggatggtccggagatacatctcggtggtgtcgacaaggtcgttcacgatgcggtcctcccagcagcgatgttaccgcgtgccggggggttgacatccgccccgggcaaggcccataagaccctaccggagcagcattccggtccgcccggctgtccgtgggagcatggcgggatggcggacgagacgacggcggcggtggtctgggacaaggccctgctcgactacgacatgggcgatcacccgctgaatccggtgcgggtcgagctgaccatggcgctcgccggtgagctgggcgtcctcgaccgccccggggtgcggttggtcactccgcggccggccaccgaggcggagctgacccgggtgcaccgccccgactatctggacgcggtccggcaggcgccgatcgatccgttcttcgccggctggggtctgaacactccggacaaccccgtcttcgacggcatgcacgagtcttcggcgcggatctgcggtgcgagtgtcgcggcggtcgaggcggtctggcacggcgccgcccgccgcgcggtcaatgtggccggtggcctgcatcacgcgatgccggcgcgggcggccgggttctgtgtctacaacgatccggcggtggccatcgcctggctgctggaccacggcgcgcagcgggtggcctacgtggacgtcgacgtgcaccacggtgacggcgtgcagacgatgttctacgacgatccgcgggtgctcacggtgagcctgcacgagacgccgctggcgctgtttccggggaccggtttctgcgacgagacgggcggcccgggcgccgaggggaccgcggtgaacgtgccgctgccgcccggcaccggggacgccgcctggatgaaggcttttcacgcggtggtgccgtcggtggtccgggcgttcgcgccggagatcatcgtgagccagtgcggggcggacgcgcaccggctggacccgctcgccgacctgatgctgtcggtggactgccagcgcgcggcgtatctggccatgcgggagctggccgaggaggtctgcgacggccgctgggtggcgctcggcggcggtggctacgccctggtcgaggtggtgccgcgggcctggacccacctgctggcggtggtcaccggggagccgctggatccggcgacccggacgccgaagtcgtggcggagactggcggccgggcgcagtccaggggtggaggtgccggagacgatgggcgacagcgccctgatcagttcccgcgcctggtccccggcgaccgaggacgacccggtggaccgcgcgatcatggccacccgcctggccgtcttcccgctgcacggcctcgacccgtacgacccccgggactgacccgatggagcgcagcgcagacgtcctgctcgccgacggcaccgcggtgcacctgcggcagatccggccggccgacgcgccggcgatcgtggagttccactcccggatgagcgaccgcacccggtatctgcggtacttctcgccctatccgcggattccggaacgcgatctgcagcgcttcgtcaacgtcgaccaccgggaccgcgaggcgttcgtcacggtcgccgcggacggccggatcacctcggtgggccgctacgagcggctcggcccggattcgccggaggccgaggtggcgttcgtggtggaggacgcccagcagggccgggggatcggctcggtgctgctggagcatctggccgaggcggcccgggaccacgggatcacccggttcgtcgccgaggtgctcccggagaacggcggcatgctgcgggtcttcggcgattccggctattcggtgcagcggcggtacgccgacggcgtggtgcacctgggtttcccgatcgcgcccaccgagaagtcgcgcgaggtgcaggagtcccgggagcatctgaccgagtcccggtcgatcgcccggctgatcgccccgcgcgggatcgccatctacggcgcgagcgccagcgggcacgggatcggcgccgcgatgctgggcaatctgcgcgacggcgggttcaccggcgcggtcgtcccggtgcatccgacggcgcccacggtggccgggctgaccgcgtaccggaaagcgtcggaggccggcgcaccgatcgacctggcggtgatctagctagctaggggcgggcggcgtggtggtcggcagcgccgggttcgccgaggccgggccggacggcgcggcccggcagcgggcgctgatcgagaccgcgcacgcggccggcctgcgggtgatcggcccgagcagtttcgggctggccaacaccgatccggcggtccggctgaacgcgaccatggcgccccggctgccggccgccggtcgggtcggcttcttcgcccagagcggtgcgctcggggtggcgctgctggccgaggcggatcggcgcgggctgggcctgtcgagtttcgtctcggccggcaaccgcgccgacgtgtccggcaacgatctgctgcagtactggcgggacgatccgggcaccgacgtggtgctgctctatctggagacgttcggcaacccgcgcaagttcgcccggctggcgcgccggatgagccgggagaaaccggtggtcgcggtggcctcggcgacccgtccgccgggtctggccggcgatctgccggggccggacgcgcacgcggtgaccgcgctgttcgcccggtccggggtgattcgggtggacaccgtgcaggagcttttcgacgtcggcatgctgctggcccatcagccgttgccggccgggcgccgggtggccgtggtcggcaactcgtcggcgctggcggcgctggccgaggtggcctgccgggcggccgggctgaccgtggccgagggctatccacacgatctgagcccgatggcgaccgcgcaggacctggccgacgcgctggccgacgcggcggtcgacgaccgggtggacgcgctggtggtggttttcgcgccgctggtgcccggccagcagctgtctgaggaggacgcggatttcgcggcggcgctgggcagtgtggcgctggccggggagaaaccgacggtggcgacgctggtcttcggccgggtgccgccgcgggttccggtctatccgtcggtcgaggaggcggtccgggcgctgacccgggtggtcaactacgccgagtggctgcgccgcccgccggggcggatgcccgcgctgtccgggctggatccggccgccgcggaggccgccgagagcacgacggagctgctcgccgcgtacggcgtcgaggtggtgccgtcgaccctggcgggttccgagcgggaggcggtcgccgccgcggacgcgctgggctatccggtcgcgctcaaggcggccggtggcggcttgcggcaccggatcgacctcggcgcggtccgcttggccattcaggatgaggatgacctgtgtacgtcgtatcgcgacctcgccgcggccttcggcccggaggtgctggtgcagaccatggtcgccccgggcgtcgcctgcgtcgtcgaggtggtcgaggacccggcgttcggcccggtggtcggtttcggtctcggcggggtggccagcgagctgctcggcgacctggcctggcgggccgccccgctgaccgaccgggccgcggaggcgctggtcgacgagccgcgcgcggccccgctgctgcacggttaccgggggtccaccccggtcgaccgggccgctctgatcgacctgttgttgcgggtcggccggctcgccgacgagcgcccgcggatccggtcgttgctgctcaacccggtgctggcccggccggacggcttctccgtgctgcacgccgcggcggaatggggcgagcccggcgtccgtccggacaccgggccgcgccgcctgcggtgatagcggtcagagaggtcagaccgcgtaggcctcgaggcgggaggcccgttccgggtcgcgcagcttcagcatggtcaccttctcgatctggcggatccgctcgcggctgaggccgaattcgcggccgacctcgtcgagggtgcgctggcggccgtcgtccaggccgaagcgcagccggatcaccgcggactctcgctcggagagggtggccagcacgatctccacctcgctgcgcaactcgccctgcgagacgccctcgccgggctggttcgggtcgaccgcggcgacgaagtcaccgagcgcgctctcgccgtcctcaccgaccgcctggtcgaggctgaccggctcacggtcgtacgagatgagttcgatgacctggaattccggcaccgccatcgcggtggcgatctcggcgatgctgggctcgcggccgagctgggcggacaggtcgcggcgggcccggaccatccggttgacctgctcgaccatgtgcaccgggatgcggatggtgcgggcctggtcggccatcgcgcgggtgatcgcctgccggatccaccacgtcgcgtaggtcgagaacttgtagcccttggtgtagtcgaacttctcgacggcgcggatcaggccgaggttgccctcctggatcaggtccaggaacgccatgccgcgtccggtgtagcgcttggcgatgctgaccacgagccgcaggttcgcctccagcaggtggttcttggcggcccggccctcggcgatcacgatgtccagcagctcggccagcgcggcgtccgcggccggcagcttctcctcggcgtagaggccggcctcgatccgcttggagagggtgacctcctccaccgcggtcagcaggcgggtgcggccgatgccgttgaggtaggcgcggaccaggtcggcggagacgccccgctcgtccgtcgcgtcgaggtcgaccacctgctcgacttcgtcggtcatgatgtcctcaaccgtcgccttcgtctccaggaccacttgagtcccctccccgttcgtcgtgcctaccagccgcatccgtgccggtgaccagaagcttcgtcgcccgcgcgttaagcggaggtgaggccagcgtccaggtggcatgaatcagggagaaccctgaagtccgcaagccgacaaggccgggtgaaacggataatgtgcaagaccgacgaaggggtgggccgtggtcttccggaggatgttgcaggcactcggggtgggcgggccgtccgtcgacaccgtgctgaccgatccgaactgctttcccggcggcttcctggcgggaaacgtccacatcgccggcggtgaccacgcggtcgacgtggagtacgtcgcggtcggcctgatgacccgggtcgaggtggagaccggcgacaacgagtaccagaccaatcaggagttccaccggcagcggctgaccggttcgttccggctggagccgggcgcccggcacgacgtgccgttccgcttcgaggtgccctggcagaccccgatcaccgagctgtacggccagcatctgcacggcatgacgatgggcctggcgaccgagctggaggtggcccgggcggtggacaagtccgacctggacgcggtgcaggtgcacccgctacccgcccaggaacggatcctggaggccctgctgcggctgggtttccgcttccacaaggccgacgtggaacggggccgggtctacggggtcgagcaggagctgccgttctaccaggagatcgagttccacccgccggcgcagtacgcgtccgggatcaatcagctggagctgaccttcctgcccacgccccggcgtctgcaggtggtgctggagctggacaagcgcggtggcctgttcaccgaggggcacgacgccttcggcagcttcgacgtcgactacgccaccgtggaccgggtggactggaccgcgcagctcgacgactggctgcggcagtccgcccgccgccgcgggttgttctagagctccagcaggatcgtgcgcggtccgacgttcacactctcgaccagcatgtgcgcccggaagcggccggtctccaccgtcgctccccgggcgcgcagcgcctccgcgtaggcgacgaccagcggctcggccacctcggccggggcggccgcgatccagctcggccggcgacccctgcgcgcgtcgccgtacaacgtgaactggctcaccaccagcagcggcgcgttctcgtcggcggccgaccggtcgccgtccaggatgcgcagctcccaggtcttgcgggccaggtcggcggctttcgccggggtgtcgtcgtgggtgacgccgagcagcaccagcagcccgtcggtgatcgatccgacgatctcgtcgtcgaccgtgacgctcgcccggctcaccgtctgcaccaacgcccgcatgccaccaccgttccgagcgccgcgccggtcgcggcgactcggataccgacggtagccgaccggtcagccggcctggtcgctggtgtactcgtcggccggggtccgcagcgccccggtggtggcgtcgccggtggtggtcggcgccacgccgggtccggtgcgcggccggttcgggaaactcgccggtcccgccgtgccgccggtggtggtcatcagcccgccggtcgacgggccgccgttgcgcagttcctccggatcggtgccggccgggaccgtgctggacaggtcggaatcttcgctgctcatgtgcacctccgtgatggtcgggccgggaatgccccaggcgggacccggcaaacgtccgtccgttggatcggagtggctcaatagctcggcggtgctccgctgatcgatgccaggatttgcctggtcgggggcggtgtctagcccggtgaccgggccgggcgttgcgctctgcgatcgaggtggacctggtttcgtgcgctgtcgtgcgccggaccgaccggactcagacgggagaatcacccatgcccctcaccagcaccaccggagggcggacgaccgaagccccgcgggccgcccgtccggcgcccgccaccactgccagccgcaccgcccgggcaccggacggcgacgccaatcggcgacaggcccgttcggtggccaaacaacagcaggcggccgagcggatcgcggcggcgaccgccgagatctccgcccagaacgccgaggccgcggaggcttcacggcagctcaccgactcgatgcagcagatcgcggcgggggccgaagaggcttccggcgcgacgcagcagagcctggccgcgatgaaccagatcgaggaccgggtcaaccggcaggagtcgaccacccgccaggtcgccgacctgagccaggccctgcaggtgctgctcaacgagacccggtccgggatcgtcgggctgctcaccaacgtcgagagcgcctcggcccggcagaccgagtccgtcgtcaccatctccgagctggagaagcaggctgacgagatcggtgagatcgtcaagacggtggcgcacatcgccgaccagacgaacctgctcgcgctgaatgcggcgatcgaggcggcccgggcccggcagcacggcaagggcttcgcggtggtcgccgacgaggtgcgcaccctggccgagaccagtgagcgcagcgcccggcagatccgcgacctgatcgacgaggtgcgcaactcggtcaccgagatcgccggcgcggtgcagacctccgccgagacggcccggggcgaggcggagaagggcaagtcgatcacctcgcagctggagaccatccgggccgacatgggcacgatcatggccggcgcgaccgagatggcggccgcggctgagcaggccaagcggtccgcgggcagtgccaagcagcggtccgaggagatcgcggcggcggccgagcagcagtcggcggcctgtgaggagtcgttgcagacggtcggtcagcagacccaggcgctgcggcagagtgagcaggcggccgaggcgctcgccgaggtctccgagacgctgcgcagcagcaccgacatcgccaagagcgccgaggacgtggcgtcggccgccgaggagctctccgcggcggtcgaggagatcaaccgcgcggccaaccagatcaacgtggcgatcaaggagatcaacactggggcccggaccgcggcggagaagggcgagcagacctcggtgctggtcacccagatcgagcagggtgcccagctctccgccgatcgcggtggcgccgcggtggaacgctcggacaccattctggagatgctcgccgccaacaaggaggcggtcgactcgatgatcgacgcgatcggccgggccgcccgcgagggcatcgagaacgtccggaaggtcaccgagctggagcagatctcccgccggatcgacaagatcgtcgacgccatcgcgaacgtctcgatccagaccaacatgctcgccgtcaacggctcggtcgagtcggcccgggccggcgagttcggcaagggcttcgcggtggtctccaccgacatccggaacctggcccgggactcggccgacaacgcggaccggatcaaggacctggtcaaggcggtgcaggaccggatcgtcgaggtccgcggcgacctggaggagaccagccggatgtcgctggccgaggtggagacggcgaaggccaccaccgcccggctggacgagatcgagcgggacatgcagcaggtccgcggcggcaacctggaggtccgcgagggcgccgagcagatcgccaaggtgctcggcgaggtgaagatcggtctggagcagatctccgcctcggcgaaccaggccgaacaactggccgggcaggcctccaccgcggcccgggagcaggcgcagggggccgaggagctcgcggccgcggtcgaggagatcgccgcgctcgccgacgagctgcagaacgccggctgagcccgaccgggggagggagcttcgatgagcgtcgacatggacgaggacgcggacctcggcgaggacaccgcggactacgtcaccttcgacatggtgggggagcggtacgccttcccgatgcgccgggtccaggagatcatccggatgccctcggtggtgaaggtgccgctcgggccgccgtccctggagggtctggccaacctgcgcggccgggtgctgccggtggtcaacctgcggcagtgctgctcgatggagcaggccgagcacgacgagacgacccgggtgatcgtggtcgacggcggcgtgccgctgggcttcgtggtggaccgggtggccagcgtgatcagcatcgatccgcaggacctggagccgggcgaggcggtgcaggccacggtccgctcggacgtgctggtcggggtgatcaagtcggacggcggggagatgaccacggtcctcgacgtcgaccggctgatcggcagccagttcgcccggctcgcggagaagcgcggccccggtggccgggagtcggtgacccgggtgtccggtgaggccgatccggatgccgatctggacgacactctggagctggtcagtttcgcggtcgagggccaggagtacgcgctgccgatcgaccaggtgcaggagatcgtccaggcgccggagtcggtcagccacgtcccgaacgccggcagccgggtgctcggtgtgatcgacctgcgcggccggctgctgccggtggtcagcatgcggcgggtcttcggcctgccggtcaccccgctggagccgcagaaccggatcgtcgtggtctccctcgacgacggcgtggtcggcgtggtgatggacaccgtgcgcgaggtgctgcgggtgccgcaccagctggtggcgccgctgcccggggtggtggccggggagggccgcaagaccgaggtggagtcggtggtccggctggaggacggcaaacggctggtctcggtgctgagcgtgaaccggatgttcgactcacccgaggtgcgtgacgagatcgccggatatcgggaggacgacgaggagatgaccgccgaacgggccagcgaggccgacgacggccgtggcgacgaggagctgttcgtcgtcttccggctcgacgatgaggagtacgcggtcgacgtcgacgccgtgcaggagatcatccgggtgccggaggcgctgatccgggtgcccaagtccttcagtttcgtggaggggctggtcaacctgcgcggcaccgtgctgccggtggtcgacctgcggacccggctgggcctggagcgcaccgagcgcgacgagcggcagcggatcgtggtgctgatcatcggcggggtgcggaccggcttcatcgtcgactcggtggccgaggtggcccgggtcgggcgcaacgtgctggagccggctccggaactctccgaggagcaggcgcgcgtggtctcgcgggtggccaacctgccggaccagcagcggatgctgctgctcgtgcaggtcgatcagctgctggcggccgagcaggcggcggtggcggccgagttgtgcgaggacgtcgtgtccgaggcactcgccggggtctagggcgatgccaacttcggtcctggtcgtcgacgactcggcgctgatgcgccgggcgctcaagggcatgctggcggaggccggcgacttcgaggtgcacaccgcccgcaacggggtggacgcgctggaacagttggagcgcgtccacccggacgtggtcaccctcgacgtcaacatgccggagatggacgggctcacctgcctggcccagatcatggagaagcagcccaccccggtggtgatggtctcctcgctgaccgatcacaacgccctggtcaccctggaggcgttgcagctgggcgcggtcgactacgtgcccaagccgggcggcacggtgtcgctcaacatcgatgaggtcgccaccgagctggtgcagaaggtgcgcggcgcggcccgggcgaagctgaagcgcgccaccggtctgaagagccggatccgggccacgccggccccgctggagacccggccggccgccgtcgacctggtgctgatcggctcctcgaccggtggcccggcgctgctctccgacctgctgccacaactgcccggcacgctgagcgccccggtggtggtggctcagcacatcccggcctcgttcaccgcggcgctggcccggcggctggatgagacctgcgcgctgcgggtgcacgaggtggaccggatcatgacagtccggcccggcaacatctacatcggccggggcggtgccgacgtggtggtcgcgcgccgcaccgacggcctgatcgtgaagtcggccccggccgccgccgagtaccgctggcatcccagtgtggaccggctggtggcgtcggcacaccgctacctggacccggcgcggctggtctgcgtgctgctcaccgggatgggtgacgacggcgccaaggagatggccgcggtccgtgccggcggcggccggaccatcgccgaggccgaggagaccgcggtggtctgggggatgcccggcgaactggccgccaacggcggcgcgaccgaggtgctcccgtcgtacgagatcgccgaccggctggccgactgggtgcgctgagaaaggttgatgatcatgggactggtcaagaagccggctgccgcgccggaaccaccaccgagcctcggcccggacgacctgatcgcgctcctcgatcaccccgacccggagcgccgccgggaggccgccttggacctggccggggtgcccgaggcggtgcccgggctgctggcccgggccggcctggagaccgagccgcgggtccgcgacgcggtgctgaccaccctggccgggcacgacacggaggcggtcgcggccggtctggcggtgcacctggccagcgacgacgccggactgcggaccgcggtggcggaggcgctggccaccatgccgggctcggtcccggcgctgttgcccgacctgctcgcggcgcccgaccacgacgtgcgggtgatgaccgcgatggtgctggccgacctgcccgacccggaggcccgcacctggctggtccggatgatcaccgacgacccgcacccgaacgtggtcaccgccgcgatcgacgcgctgctgcccggggccggtcccgagcacgccgcggtgctggaggccgccgcccagcggttcccggacgacccgttcctgatcttcacggtccgggcggcgctgccccggctgaccggtacggcctgatggcggccgcggcaccctcgggcaccggactttccgacgccgagttcgaccggttcaccgaatacttctacaagcgcaccggcatccacttcaccccgggcaagcggtacttcgtcgacaagcgggtggagacctgcatccgcagttcgccgttcgacacgttcgcgagctggttcgccgccctgcggatggaccggccggacatgctgcaggaactgatcaaccagctcaccgtcaacgagacgtacttcctgcgcgaggactaccagttcgacgcgatgctcagcacggtgctgccgaagaccctggccgcgcgcggcgggccgggccggatgtccggaccggtcaagatcctctcgctgccctgctcgaccggcgaggagccgtactcgatcgcgctgcgcctgctggaggagtgggaccagatcgaccatgtggacgtggagatccacggggccgacatcgacagcgaggtgctggccaaggcggcgcacgccagttacggcgaacgctccctgcagcgggtgccgaaagcctgggtgaacaagtacttcacctcggtcgggtccggccgcttccaggtggacgagggcatccggagcgcggtcacgctgcaccggatgaacgtctgcgacaccgccgcgatgaaggcgttccgggacttcgacgtgatcttctgccgcaacgtgctgatctatttcgacgagctgtccagtcgccgggccgccgagaacctgtacggggcgctgcgcccgggcggctacctcttcctcgggcactccgagtcgatgagccggatctcgccgatcttcaccccgacccgcctgccggagggcatcgtctaccagcgaccgaccggagcgaagtgatgacccgggttcttgtagtggatgacgccgccaccgtgcggctctatcacaccagcctgctgcgcgacgccgggttcgaggtggccgaggcggcgaacgggctggaggccgtcgaggcggccatgaccacgccgttcgacctgttcctggtggacgtgaacatgccgaagatgaacggctacacgtgcatcgagacgctgcggtcggagaccgtcggcacggccgccccgatcctcatgatcagcaccgaggaccggcccggcgacgcggaccgcgcgtatcaggccggagcgaatctctacctggtcaagccggtcccggccgatcgcctgatccgggtcgccacgatgctcacctccggaaaggacccggaggcatgaacccgctgctgtcccagttcctcgccgaggcgaacgatctgctcgcctcggtcgacgacggtctgctccagctggaacgcaaccccggcgatcccgagctggtcaacgaggtgttccgggccgcgcacacgttcaagggctcgtccgggctgttcgacttccccgagctgacccggctcacccacgccgccgaggacctgctggacgcggtccgcggcggccggctcgcgctcgactcgggaatggccgacgacctgctggccgccttcgacctgatccgcggctggctggcccacgtcaccgcgcacgagcggctgccggccaccgccggccaggacgccgccgggctgatcacgaagctgcgggcgccgctcggcggcgagccttcggccgccgatcaggagccgatcgccgcggtacgacacgtcgacgccgctccggactggctggccgagctcggcaccgagtggttgatcgagaccgccacctggctcaacaccacgtcgtccaccctgcggttcctgcgctatctgcccgaccaggactgcttcttccgcgccgaggacccgctgcatctggtccggcagatcccgggcctggaccggatggtcgtggtcccgccggccacctggcccgccgtcgccgagtacgacgaatacgcctgcctcctctccttcgtggtggccacccgggcctcgtacggcgaactgcaccatcttttccgttacgttcccgatcaggtcagctacgtcgagctggacgccgccgcgatcaaccggcacctggagggcgaggacgccgaggagatcaccccgccgccggtccccgagccactcaacatcgaccccggcctggccgccgacgcccgcgcggtgctcaccgccgcgcaccgcaccctggccgtcggcgaaccggccggcacccagctggtcgccctgaccgcgtcggtcaccgcggcggcccgggcgctgggcgtcccgctcgatctgaccggcgccgacgccgaagcggtcaacgcctagctagctagctcgccggtgatcgccgcgctggccgctccgccggcgccggtgccggccgccgaaccggccggccgggccgacgaccccggcggtcaggtcggcacccgggtgctcaaggtcgaccaggagaaggtggaccggctgatggagctggtcggcgagctgaacgtggccaagaacgggctcaccttcctggccgccgcggccgaggaggagttcggcagtcgagcgctcagccgccggatcaaggaccagtacgccgggctgcaccggatcgccgaggagctgcaggccgccgtgatggacgtccggatgctgccgctctcggtcgccttcggccgcttcccccggctggtccgggacctgagccggcggctcggcaagaccatcgaactggtcaccgagggcgacgagacgatggccgacaaggacgtcatcgaggcgctcggcgacccgctggtgcacctggtccgcaacagcctcgaccacggcatcgagaccaccgaggagcggatcgcggccggcaagcccggcaccgcccggctcaccctggccgcggtcgccgacggggacgcggtgctggtcgaggtctccgacgacgggcgcggggtcaacccggcgcgggtcaagcagaaggcgtacgaaaaggggctgatctccgaggaggagctggagtcgctcagcgacagcgaggccgtcgatctggtcttccgccccggcttctccaccgccgaccagatctccgacctgtccgggcgcggggtcgggatggacgccgtccgggccagcgtcgagaaactcggcggcagcgtcaccatgcgctccgagctgggcaccggcaccaccacccggctgcggctgccgctgtccatggcggtcacccaggtgatggtggtcagcgtggccgggcagcgcttcggtgtcccggtcgacctggtggtggagacggtccgggtgccggccgccgagatgggccgggtgctgcaccaggacgtggtggtgatgcgcggcgaggtggttccggtgatcgacctggcccgggcgttgcagatgccctgggcggcggatccggaccgggaccgcgcggtgctgatcgtctcggtcaacggtcagcgggtcggcctgctggtcgaacagttccaccgggaggtcgacgtgatcctcaaaccgatggagggtctgctcgcctacgccgacgagttctccggcaccgcgctgctcggcgacggcctggtgctgctggtgctcaacctcaaggaggtgctcggccttgccgctcgagctgcatgacgagaacgccaccctgatcggcgtggtcaccgtcgacgaggtggaacaactggtcggctggctgcgctcgtgccagcggccccgggtcagcctgcgccgttgcaaccatctgcacaccggcgcactccaggccctgctgcttttccggccgaagatttcagcagcaccgaaagacgccttcctgacgtcccaggtgctgccgctgctcaccgggagcaacggcgacaccggccgacaggggaccgaaccgccatgaccaccgtgatgctcgtcgacgactccgccaccatgctgatgagcctcaagtcgatcctgaccaaggccggatactcggtcgagacggccgggcacggcaaggaggcgctcgacaagctcggcaagggcgtcaagcccaacctgatcatcagcgacgtgaacatgccgcagatggacgggatcaccttcgcccgtgaggcccggaaggctccgggtatgcggttcaccccgatcctcatgctgaccaccgagtcggatcaggccaagcgggtcgaggcgaagaacgccggcgcgaccggctggctggtcaagccggtcggaccggaccagctgctgggcgtgatcaagcaggtgctgcccggggcctgaggcccgtccgaagcgcaacggaggtaccgcacatgcctagccttctccgcaggctcacgctcgccccggaacagccggaggagcagggcgtttccggggatgtcgtggccgaggcgctggagccgatcccggcgtactgcgatgtgatcgacggccacgtcaaggacgtcatcgagcagaccggtgaggccgcacacgcgatcgtccagcagatggtgaagatcgactcgttggcggaggtgatggccggcgacgtcgcccagctcgccggcaccctcagccgcaccgaacgggagctgtcccaggtcagctcctccaacgaccagctggtcagccggctgatcgcctacttcctgcaccgcgaccaccagatccgggcgctcgtcgagcagatgcgtgagctcaaccagcacgtcacccagatcgaggaggtcagccgggccaccaacatcctcgcgctgaacgcgatgatcgaggcggtccgggccggcgacgccggcgaaggcttctcggtcgtcgccgacgaggtgcgcaaactggcgcaccgctcgtccgaggcggcgcacggcatcggcagcagcatcggcgacctgaccgcgaaactcgacgcggtactctccgacgacacccagttcgatcgggccgcggagatgccaccggtcaaggaggagaccgcgatgacccgccggctgggcggcatcgccaacgctcagcgggagatgtccgagatggtctccggcatcctgcgggacaccgtcgtcgccgcccgccaggtgcagaccagctcgaacgcgctgacctcggagaccaccggggcggtggggcacgtgcagttccaggacatcagtcggcagatgttggagcatgttgcggaggcggtcgccgacgtgcgcgggcaggccgagtcggtggccgggtacgcccagggccgggtcaccgccgacgaggtccgggacggggccatcaacgtggaggacctccgctcgaaacacgtgatggcccggcagcggttcacccatgccgcgcagaccggtgaggacgcctcagccgggaccgaaccgttgatcgaactgttctgagagggtttgtgatggcgcgcatcgaggattacggccacgaggcgccgaccgagcaggacgcggtcaaggcattcgcggagctggtcggcccgcggatggccgaggggctgtggagcctcgccgtgcagtcgctcggcctgcagcgaccggtgtccagtccggccgacctccggcgggtggccgaacacgtgatggaggtcggcgagctgagccgggtggccgggcgctcgctcaaggtccggctgatcacgtacgaggcgctggcccggacggtccagtcgtgaccgcgcggcaccccgaccggatccgcgacctggcccgcctcggtctcgaccgggaggaacaccgcggctacctgggcgagctggtcaaaaccgtggccgaccgcctgcagaccccgttcgcactggccgacgccctactcaacgacgcgcaggtgttcctggccggcaccggcccggtgccggactggatcggcgaatccggcggcaccccgctggagtgggcgttctgcacccgcttcctcaccaccagcgccccgttcaccgtcggcgacttcaccgaggacccggaacaccgggacaacccgctggtgcgcatcgagggggtccgctcctatgtcggtgccccgctgatctcctcgaccgggcacgtcctcggcggcctgtgcgcgctggacgtgcgcccgcgccacttcaccgaggacgacatgcgatatctcagcgggatggccgccgaaaccgtccgccgcatcgaggaccacgccggccgggccgcctgagcgagactgccgcaccgtccccgccggtcgcaatggcagcatgtaccgcatgacgttttcgctgcccatcccggccgaggccaacgcgctgctggaccggagtccgctggccgtgctgctggggctggtgctggaccagcagatcaccatggagaaggcgttcacctcgccgctggtgctggcgcagcggctcgggcacgagcccaccgcgaccgagatcgccgacttcgatccggaggcgctggtggagatcttcgcgactccgccggcgctgcaccggttcccgaaagcgatggcggcccgggcccaggaggtgtgccgggtgatcgccgatcgctacgcgggggacgtcgaggcgctctggcgggacgcgtcgagcggggccgagctgtaccagcggatcttcgcgctgcccgggttcgggaagcagaaggcgcagatcttcgtcgcgctgctgggcaaacaggtcggggtgcagccgtcggggtggcgggcggcggccggtgggtacggcgaggagggcgcctaccggtcggtggcggacatcgtcgacgatgaatcgctggcccgggtgcgggagaacaagaaggcggccaaggcggaggccagggcggccaagggctgattcgcggccgatgccggcgggtggaccgggcgaatgggcggactggttgggcagaaaggcccgtccggtgcgaggatggcggggtcgaacgggagacccctgtgaagaagcagccctcggtcctgatcacggatgccgcgcggagccctggcgatcagttgcgcagccgcgaggtccggtacgtgttgatgatgggcacccgggtgggctgcctgatcctcggtggggtgctggtcagcgtgcggccgccgctgctcgccctgtggctggtgctgtgcctggccggcatggtgttcctgccgtgggccgcggtgctgatcgccaacgaccggccgccgaagaccaaggcggaacgggccgcggacgccgccgcccgggaacggcagcagatggcgttgaccgaggtcgtgcccgaggagcgggagccggtcacgatcgactccgagatcatcgaatcggacaaaaagctttaaatagcatatgtcgtatgtccgcgctgataactgaccgccgctcccgccggggccgggtcacgatgatctggccgctggcgcgtccatagcgatcatcgcgacccttcattgcccgtggatggtcaccgagaagaccgggtccggcggcagcagccgggcggcgtccgtggttgctcaccgagagagccgggtctctcgcgcggcagccgggcggcgcccgtgggtggtcatcgggagggatcggggcgggcgccgaggagttggacagcggctgctccgagggcggcgccggcttgcagggcggccggcggcgagccgtcgttgagccaggatgtcagcaggccggcggcgaaggcgtcacccgcgcccgtggggtccttgaccggcacgctgaggcccggagcggaccatgcggaaccgtcgcgggtggcccagaccgccccggccgggccctgcttgacgaccgcatggcggacggtcgcggtcagccgcgtggcctgtgccgcggcgggggcggggccggccagcacgtccgcctcgtccgcgttgcacagcaggaggtcggcgtcgcgtacccaggtcaggaaagcggacgcacccgcgtcccgcaacggtgcggcggacgccgcgtcgacgctcaccgtgaggccctgctgcctcgcggccgcgagggccgccaggcccgccgggcgggacccggcgtgcagcagcggatagccggacaggtgcagatggtcgcccggcgcggcggcccgcagcgcggcggtcacgtgcgccggatcgagcagcaggcacgcgccccgatcggtgatcatggtgcgttccgacgcgccggtcagcaccaccacgctgccggtcgccgcacccggcagcacccgcaccgcgtcgccgaccccggccgcgaccagctcggcgacccggtcccggccggcctggtcggcaccgaccgcggcgaccagcgtcgtggcctgcccggcccgggccagccaggccgccgtgttggcggcctggccgccgccgctgacccggatcgcggcggccgtgtccgagcccggccggatcgggccgtcatgctccaccagcacgtcggtgaccaggtcaccgacgacgatcacccggggcacgacacggcccgcgagaggtgagcggcggcccgggcccgggaaccggtccggaatggcgagccggcccggggtcgggtagccgccgggggtcgggaagtggcccggggtcgggtggcggcccggggtcgggtggcggcccgggaacccgaagcggcggcgagaacgcgcggcacggctcaggccggaacggagaagccgagcggcgcggcggtcccggcgctctcggcgaccgcgatccgggccgccagcgcggcgttgcgcaggatgatccggacgttggtggtcaggctctgcccgtcggtgctggagtggaagtgcgccagcaggaacggggtgaccgccttgccggtgacgccctgctcggccagcgccgccaggccgctcgccagggtgcggtcgtgcagctccgggtccagctgctcgtcggtgggcagcggattggccagcaccagcgcgccggtggtgacgtcctggtcgcggcgggcccggatgaagtcggcgacctgctccggcgagtccagctgccagtcgacgtcgaagccgccgtcggtgatgaagaagccggggaaacgccgggtgccgtagccggccaccgacacgcccagcgtctccagccgctccagggtggcgcccacgtcgaggatcgacttcacgccggcgcagaccaccacgatcggggtgcgggccagcgcggtcaggtcggcggactcgtcgaaggtgaggttcgcctcccggtgcaccccgcccaggccgccggtggcgaacacgccgatcccggccgcggccgcgaccgcgctggtggcggcgaccgtggtggctccgtcggcccggtgcgcggcggcgatcgccaggtcgcgcacggacagcttggccacgtctccggcgagcgccaggtgctcgatctgggcgtcgtcgaggccggcgatcagctcgccgccgatcatgccgatggtggccggcaccgccccgttgtcccggacggtctgctcgatctcccgggccactcgcaggttgtccgggtgcggcagcccgtgcgagatgatcgtgctctccagggccaccaccgggcggccgtcgcggcgggcacggatcacgtgctcgccgaagcgaatagcgaagtcagtcacggtgcccacggtacgggccgtcttggctgcgttgtcgttggaccgaccaggggtgaggtgtcagacttgtcggctggagcttttctccacccacttttgtgatcttctgaagggcagatacctgtgagcacccagatcctcgagcgtccggagaccaaggacgccgacaccggtccggagatgttccactacgtgcgcaaagagaagatcgcggagagtgccgtgatgggcacctacgtggtcgcgctgtgcggggagaccttcccggtcaccaaggtgccgaagaagggctccccggtctgtccgcagtgcaaggagatctacgaagccatgaaggcctgatcgggccgtggcgagcggatacggactgctcgtcgcggatctgatcggggtggcggtgttcgccgcctccggggcctcggccggcgtcgcgaaacgcctcgacctgttcggggtggcgttcgtcggtttcgcgtccgccctgggcggcgggatcctgcgcgacctgacgatcggcgcggtccccccgctggcgttcgccgactggcggtacgcggtgaccgcggtgctcgcctcggtcgcggtgttctggctgcaccctcggctgcaccgggtgcggcggacggtgctggtcctggacgccgccggcctcggactgttcaccgcgaccggcacactgaaagcgctcaccgccggggtgccaccggtcggcgcctgcctgctcggcatgctgaccgcgatcggcggcgggctgacccgcgacctgctcaccggtgagatcccggtcgtgctgcaacgcgacatctatgccagcgtcgccttgggcggcgcgatcctcgtcaccggaatgcagcggctcggccacaccggtccggtgccgctggccggcgccgcggccctgatgaccggggtacggctgctcgcgctctaccgacgctggtcggcgccggtcgcggtgccgtgacccgcggcgggcccggtccgcggctatgctggatgctcgcctccgcgacctctgccgcggaggtttttccatggatgaagggatcaccggagcttgagcccgtctctgccgaatctggagatcttcccgccgttgcgggcctggcagcgcaaggcgatggtggaatatcttcgccgccgttccgaggacttcatggccgtggcgacgcccggcgccggcaagaccacgttcgccctgcggctggccgccgagatgctggtcgacggcaccgtcgacgcggtcaccgtggtctgcccgaccgagcacctgaagtcgcagtgggcgcaggcggcggcccgggtcggcatccagctcgacccgcgattccgcaactcggagatccactcgtcgcgggacttccacggggcggtggtcacctacgcccaggtcgggatggcgccgcaggtgcacaagcggcgcaccatcacccggcgcaccttcgtcatcctcgacgagatccaccacgccggcgactcgcgcagctggggtgacggggtcaaggacgcgttcgagccggccgcccggcggctgctgctcaccggcaccccgttccgctcggacgagaacccgatcccgttcgtgcagtacgagcgcggcatggacggcatccagcgctccaaggccgactcggtgtacggctacggcgacgcgctgcgcgaccgggtcgtgcggccggtgatgttcatggcgtactccggggagacccgctggcgcaccaatgccggtgacgagctggccgccaagctgggcgagccgatgaccaaggatctgatcgcccaggcctggcggaccgccctggaccaccgcggcgagtggatgccgcaggtcatgcaggccgcgcacaaccggctgctgcgggtccgggagggcatgccggacgccggtggcctggtcatcgccagcgaccagacggcggcccgggcgtacgcgaagctgctgcacgacctgaccggcgaggcgcccaccgtggtgctctccgacgacgacggcgcctccggccggatcgccgagttcgccgcctcgcagaagctgtggatggtcgcggtccggatggtgtccgagggcgtcgacatcccgcggctcgccgtcggcgtctacgccaccagcgcgtccaccccgctctacttcgcgcaggcgatcggccggttcgtccggtcccggcagcccggcgagaccgccaccgtcttcctgcccagcgtcccgcacctgctcggactggccagcgagatggaggcggaacgcaaccacgtgctcggcgcgcccaaggagaaagacgggctggacgacgagctgctggaacgggcgcagaagtccgaggacgccatcggcgacctggagaaacagttcgaggcgctgtccgcgaccgccgagctgcaggaggtcatctacgacggcacgtcgttcggcgtgccggcccgcaccgggaccgccgaggaggccgactatctcggcctgcccggcctgctcaccccggacgaggtgaccatgctgctgaacaagcggcagaccgagcagctggccgtgcagaaacgccacgagcaggaagcggcgaggaacgcgccggagccggccccgcgcgaggcggtcgtgccgatgagcgccggcgagcgccgggccaccctgcgccgccagctgaacaccctggtcgcggcgcaccaccaccgcaccaacctgccacacggcaagatccacgcggagttgcggcggctctgcggggggccgccgagcgcccaggccacgatcgagcagctggaggagcggatcgccacgatccagaccttctagataccttgtgtgtggccggtcaccgccgataagccaccgggggaggtgtctatgcgggagaccacgcagcacgccgtacgcctgctggagcgggcgcagaccggcgacgccaccgcggcgctcgccgaggcggaaaccgtgctccgcagccctggcggcgacctcgcctgcatgcacttcgtccgggtggtgtgccggatcgcccagtccgacccggccggcgcgatcgccgcggtcggcccgatgctgtgcgccgccgagcgggagggcagccgcggctggcaggccgccggcctggccagccgcgcgtggcagcggctgcgcgccgcctcgaccggcgggatgaccgccgaccacgacaccgacgaggtgctccgcgacctggtcgccgccgagatgctggccgacggcgagcccgacccggtggccgcggtcaactcccgggtcgcggtcgccatcgggtggtacgagctgcggctgtacgagctggccgagccccagttcaccgtcgcgtaccggatgagcagtgcggacgccggccggaacggcaaccgggcgatgtggtcgctgaacctggccgagatgcacctgcgctgggcgctggagctgtaccagatccaccggccggccgaggccgagggccacagcgccgaagccgagcggtacgccatccgggcggccggcgaggtgtccggcgccgacgcggcctgctggcgggacaacgcgctgctctacgccgcctgcgcccgcgccgaccggcacgacccgggcggggccgcggccgacatcgtgcggtacaccgcgcgactgcgggaccgcggcttcccgaccgacgcgctggcgatcagccggcccttccacggggtggcgctgctgcgctccgggcggcccgccgacgccctcgcggtgatggccgaggcggccaccgggctgccgcccgacgcggactggctggtcgtcgccagcacccaccgcacccgggcggtcctgctggcccacctcggctcggcggacgccgcggccaccctggcctacggggacggcctggccgccgccctgtggcgccagcggctgaacacgctgcacgccgcccgtacccggtacgacctggaacagctgcgcgtccagcacgagcaggtcgcgaaggccgccgagatcgacccgctcaccggcatcgccaaccggcgcgccttcgaccaggcgctgcacgccgcgctgtcccggcccggcgacgctgccgtgctgctcatcgacaccgacaagttcaaggtgatcaacgacacgctgggccacgccgccggcgacgccgccctgcgcgccatcgcggccgcgctgctagctagctagcgccgacctggtggcgcgcctgggcggcgacgagttcgcggcgctgctgccgggcgccggggcggcggaggcggccgcggtcgcccgccggatggtgcaggccgtccgcgacatcccggactgcctggccacggtcagcatcggcatcgccgtcggtccggctgccgccctgcacgacgtgctggaacaggccgacgaggccatgtaccgagccaaacaccgcggcggcgacggcaccgagacaaccttcaccccacagaaccgagccgccgcctgacccggccccgagctcgccgtcccagcggattcagccacctcacggccggactccaccgagccccctcaccggccggactccaccgagccccctcaccggaccgactccaccgagcccacctcaccggaccgactccgtcagagccacctcaccggaccgacctgagctagccgaccactcaaccggcctcgaccgacaggtccgcgcggccgccccgactagccgaccgatccgggtgggcttcccggccccacccgaccggtccgcgcaggattcccggccttggttgaccggtccgcgcagactcgccagcctcaaccgaccgatcccgcccgggatgactcggccggccggggtggagctacggcttggcgatgtcgtccggcccgctcatttgcccatggcgagcctcgcggggcgggtctggggtccagtgaccacccgcgggcggtagggcgcggtgatttgttctggacgcgcagcggccaaaatcgccgtgcccgggagcggcgggagcagcgatcagttatcggccgcagcgcacgacatcatgatgttgatcttgctctgggtcttctggaaaagagttgcccgggagcggcgggagcagcgatcagttatcggccgcagcgcacgacatcatgatgttgatcttgctctgggtcttctggagggaagctgcccgggagtggtgatcgattatcggccggagcgcacgacatccgcctggcaaatttgatcttgatcttccgaggacgcaccggcgagcacggtgaaggggcgcctctcgcgagacgccccttcgattccgtcttcagttgggggaccgctgttagttgctggagttcgacatcatgttcgcaccgcgccaggtgaactccggatcggcggagaactgcaccgcgatcttcaccagatcctcggcgtaacggttggcgtggtggccgcagaaaacgaggtcacctccaccagccagggtcaaacggagcttcccggctgcattgcagcggtcgcaccgttcatcggctgctgtgccggccaggcttcccgctggcggcgtgagagtcggggtcatcgccttcctcctctgttcgtcaccgatgaacatgttcctcggctactgctaacacatggtgcaacactctgcacccttgcggccttcccgtagtgccccggggggaccgaggtcacaccgattgcgactagtgtgccgtgttcccagggtgccacgtcaacgatcacttctgcacaacggtctgatcaccacccgttgatgtacgggtggtgaccaaacggacacgtaatgttgaccgatcggtctagtcgaggtagtcgcgcagaacctgcgaccgtgacgggtgccgcagcttcgacatcgtcttcgactcgatctgccggatccgctcacgggtgacgccgtagacctggccgatctcgtccagggtccgcggctgcccgtcggtcaggccgaaccgcagccggaccacgcccgcctcccgctcggagagcgtctgcagcacctgctggagctggtcctgcagcagcgagaaggagaccgcgtcgaccgcgacgaccgcctcggagtcctcgatgaagtcgccgagctggctgtcgccctcgtcgccgatcgtctggtccagcgagatgggctcacgcgcgtactgctggatctccagcaccttctccggcgtgatgtccatttccttggccagctcctccggggtgggctcacggcccaggtcctggagcagctcgcgctggatgcggccgagcttgttgatgacctcgaccatgtgcaccgggatgcggatggtgcgggcctggtcggccatcgcgcgggtgatcgcctgccggatccaccacgtcgcgtaggtcgagaacttgtagcccttggtgtagtcgaacttctcgacggcgcggatcaggccgaggttgccctcctggatcaggtccaggaacgccatgccgcggccggtgtagcgcttggccagcgagaccacgagccgcaggttcgcctcgagcaggtggttcttggcccgctcgccgtcccggttgatccacttgaggtcacgctcgaagttgcgctcgagcgtctcctcgccctcctcggcggcgcgcagccgctcggcggcgtagaggccggcctcgatccgcttggcgagctcgacctcctgctccgcgttgagcagcggaaccttgccgatctgcttgaggtaggcgcggaccgagtcggccgaggcggtcagctcggcgtcccggcgggcctgcttgagcgcctcggactcctcgtcgtcccactcgaagtcgccgtcggtggccgaactggcggcgtcggtcgcggcggccgcgacgagcgcgggcggctcctcgaccaccacgtcctcgatctcggcggccagctcctcggggtcgatctcctcgccctcgggaccctcctcgccgggcttggcggctttcgccggggcggccttggcggtgaccgcggccttcttcgccggggccgccttgcgcgcggccggcgtggccttcgccgggtcggtggacggggcggcggcctgcttcggggcgggcgcggccttcttcaccggggcggcggtcttggcggtcgtcgccttcgacgccggggtggcggagcgggcggcggccaccttgcggcgggtgctggccgagccgtcgaccacgaccgtgatcccggcgtccaccaggccgcgcagaatcttcttggcctgtgccgggttgacggcggcggactcgagcgtgtgcgcgacctgggccgaagtgagctgcccgcccgcaccctgggcatgggtgatcagggcctcggtgagagagcgaacgtcggcaccgttctggtgggcttctgtcacgaatgaccttccggaggcgatgagattgggcacggccatggtccagcgcagcacgccggaggcgagtctcgccgggttgatgtgggaacccccgggtcacggaccgtcccgcagtgagtgtccgtgaagcgtgggcaggggtgaattgtagcgccgtcgaacgagatcctccccccgcagcacgccgccggggcccgacgacctcgtcggcacgggctctgggcgagaatcgtatcggcggaaaggacccatacgtgagcgagatttctccgggatcgacacccggcgagctgctggagatcgctgtccgggtggcccgggaggcggcggccacggcgagccggatgcgcggcgaggcgatcggcgacgtgcagaccaagagcaccgacacggacgtggtgaccgcggccgaccgggcggtcgagcggcaggtggtggcggcgctgcgggccgagcggccgggggacacggtgctcggcgaggagtacggcggggcggccggcgcggcgcccggcgcggtccgctggatcctcgacccgatcgacggcacggtcaactatctgtacgggctgccgcagtacgcggtctcgctggccgccgaggtcgacggcgaggtggtggccggcgtggtgcgcaacgcggcgaccggcgacgagtggaccgcgacccgcggcggcggcgcctggcgggacggccggcggatcagctgctccaccgagaccgtgctggggcaggcgctggtcggcaccggattcggctacgaccctcggcggcgggcccatcagggccgcgtcttcgcccagatgatcacccgtgtgcgggacatccggcgcctgggtgcggcatccttggacctctgcctcgcggccgagggcagactggacgcgttcttcgagaaaggtctcaatacgtgggatcacgcggccggtgggctgatcgcggcggaggccggcatggtcgtgtccggcctgggcggcgccccggccggtccggagatggtgctgctcgccccgccggcgctccatcccgccctgcacgacctgctggtggaggtggacgccgccggtgggccctagggccggtcctagtcgttctcgggcttcttggtgaccggcttgaggcaggcacccggcggcagggtcggctcgccgatctcgaccagcgactggttgacctcggtggtggtggccagctgctggaagtcgctgccgatcaccacctcgatcagctcgcccttgcgcttgtcgctgtacaccatcttcgcctgagccaggaagtacgccttgaccagctgcgccttgccgaccgtgtcggggccgaagcggatctccgccacgcccttgagcttgctcttgctcttgcccgggtccttgaccgtgaagcggcggttcttgaactcggtggagacgctgtcggccaggccggcccggttggtcccgttgaggatctgcagggtcacctcggccgggtcgtcgggcaggtgaatgtccgcggccggagcgccggcggcacacttgccgccggccgcgatgtccgcctgatcgtcgcgcaccagcgcgacgatcacgaagacgatcgcggcaaccgcgagcacgccgacgacgacgagcgctcggacgcgcgcaaaactcatgggattggctccagatcagacgaccggccgcggtgaggtcgccgcgcctgtcgagaggttagcgtgggtccgccagccgcgcggaaacaggcgatgcttccggcgcgccgacgatgatccagacgctggtacccctactttgatgtcgcctcagtcacatcgggaacaatgtgccgccagtgggcgtacaaccttgccgcaacggcggtaaggttccgcgctcgccgggcccgaacacggtgttcgcgcgagtgtcagaaatcgtctggcggaaccgggaaccgaaaccctgtcatgggcgttactaacgccaagtgacacatcgatacaggagagtgaaaaccgatggccaccgactacgacgccccgcgtcgcgatgaggtcgacctcggcgaggacagcctcgaggagctcaagtcccgccgcgccgactcccagtccggcgcggtggacgtggacgaggtcgaggtggcggaaagcttcgagctgcccggtgccgacctcgccgacgaggagctcaccgtcaaggtgctgccgatgcagaccgacgagttccgctgctcccgctgtttcctcgtgcaccaccgcagccagctggcgacggagcgcaacggggagctgatctgccgcgagtgcgcctgaccggcgtgctcgcgcgcagagcgccgacacccgcccgcgggcgggcccacacggggatggacacggggtttgaccctggtgcggtaccgggcacagtaccggtgacgacgacgggaaggacgacgatggatgccaccggcgacgacgaggagctgggccgcaccgttgcggccctgaccgccgacgacctggagtcgtccggccgtcggcgcctgctcggccggctggtgggtgacgtgcgccgtcgtggcgtgggccggttgttcaaaccccgggccgcgctgcgctggatggccgaggtggtcaccgacgtggcgccgcacatcccggtccgtgaccgggagacgctgcgccggcatttccccggcctggacgacgacgacctggcggatcggctgatccgcaacgccgcccgggccacggccggcgtgggcgcggccggtggcggggtggccgccgtcgagtgggtcgccgcgccggtgctgctgtccgcgccggtgctgctgtccgccgagacgatcgccgtggtcgcgatcgagatgaaactgatcggcgagctgcacgagctgtaccgggagccgatccccggcaacgggaccgagcgtgccctcgccctgatccagtcctgggccggccagcgcggggtcaacccgctggtgcccgggaccggggtggccagcgtgctgggcaccgccgcccgcggcgagctgcagaagaccctgctccgccggttcggccgcaacctgacctcgatgggcccgatgctgaccggcgccgcggtcgccagttacctcaaccggcgggccacccgctcgatcggcgacaaggtgcgcgacgacctcaggaagcgggctctgacgaggcctgaccggcccgcgctggacgactgaccgcgagcagcgcggtggccagctcgaccggccgccgggtgctgaccacccagtacggcgtggggtcggccgggtcgtcgagcagcacctgcaccgcgccgccgatccacgggcgctgcaccacgaaggccagcgggtgcgcgccgacgcccagcgcctcccgcttgcccgccgcgtccagggccaccacgtcggcgatcaccgcgaccggcagtcgcgcgtcgtcgaccaggaactcgccctcgcgcacggccacccgcagccggcccagcgggagcgggagcaggaccgcgagcgggacgagcaccgcgtacggcagccagccgggcagcccgggcagagccagcgccacctcggtgcccaggatcgcgccgatcagcaggcccgccggccacacccaccagggcagaccgaggcgttcctgataggccggggtgctgcgggccggggactcgggtgtcaccctcgaagggtacggcgcgcctccgtacccgggcacggcaggatggcagggtaggcaccgccccggagcgtcatcgaagtgaaggattcccgcgtgagcgacgtcgtcatcccggtccggctgatcgacccggatctgccgctgccggcctacgcacaccccggtgacgccggcgccgacctggtcgcggcgcaggacgtggagatcgcgccgggggagtgggccaagatcggcaccggcatcgcggtggccatcccggagggtttcgtcgggctggtgcacccccgttccggtctggccgcccgcctcggggtgacggtgctcaacgcgcccggtacggtcgacgccggttaccgtggcgaaatcctcgtcaacctgatcaatcacgaccgggcgcgggcggtgaagatctcccgcggcgaccggatcgcccaactcgtggtgcagcgggtggagcgggcggcgttccacgtggtggactcgctcgacgacaccgcccggggcacgggcgggcacggctcgaccggtggattcagcgaaggaaaggctggcagtgatgttctcccgtaagcgcgagggcgccaagcacgtacgcgcggccgacgcgccgccctccaaggcgctcgcccagagcctggcggccgatggggaggccccggcgcccgagttcgggccctgggacgtcaagcacgctccgggcgacgtgcagcggctcgacctgggcagcctgcagatcccggcgatcgagggcgtcgaggtgcgggtgcaggccaacccggagggcggggtcgagcagatcgtcctggtcgacggcgagagcgccctgcagctcggggtgttcgcggcgccgcggaccgaggggatctgggacgaggtccgcgaggagatcgccggcgcgatgaccgccgacggcgtggcggcccgcgaggtgaccgggcggtacggcaccgagctgctggcccgggtcaacaccccggagggcccggccgacgtgcggttcgtcggggtggacggcccgcgctggatggtccgggcgctgttccagggtgcggcggcggccgacccgggccgcgagggtgtgctgggcgtggcgctggagggcctggtcgtggtccgcgacgacgagccgcgcccggtccgcgagccgctgcccctacggctgccccgggagatggccgaacagaaccccgcacagcaggtttgaccctcgatcgggttaccgtgaacacatgaccaccgagcagcgcaccggcctgcgccggttcctggacaggttgaccgcgaccgactccgagctcgatgccgaggagttgcagcgggatgcggtgaagtgtggcgccatgccggccgggcagtgccggcgtggccaggtcgtttcggtgtccggccggttgcgcaccgtggcgtacactccacggaccaacctgcccaccctggaggccgacctctgggacggcagtgacgtggtcacgctggtcttcctgggccgccggtcgatcgccggcatcgagcccgggcgccagctcaccgcgcgcggccggatcgcgatccgggacgaccgcaaggtcatctacaacccgtactacgagctggaggcgccgcggtgacacccggcaacgagccgcgccacgtggcgcacgaaaccgtcgaggagcggctcgccgaggacatcgtcgaggagctcgacctgcacccggcccccgctccggacgaggaggaggcgctcccgccgctcagcgagcagatcgccgaccaactgggcggggtgcgcgggctgatcgagtccagcatcccggtgctggccttcgtgctgttcaacgtgctgctcggcgaatcggtcgccggcctggacaagcagaccgcgctgacctgggcgatcgtcggctcggtcggctcggcggtggcgatcggcggggtccggctggcgcgccggcagccggtccggcacgcggtcaacgggttgttcggcatcgctctgggtgcctacttcgcatggaagagcggcgacgccaagaacttctacctgcccggcatcctgctcaccttcgggcaggcggcagcgctgctggtgtcggtggccttccgtaaaccgctgatcggttacgcctggggcatcatggccaacaagggccggcaggactggttcggcaacgcccggctgttccgcaccttccagtggctcaccctggtctgggtggcgtccctggcgctgcgcgccggcatccagttctacctgtggaagctcggcgaggcgaacgccctgggcatcgtccggatcctgatcagctggccgatctacgccgcgacgttcgccttcaccgcctgggccatccaccgggtcacctcggcccagaagagctcctagccggcggcgcccagcaccacggcgcggatctggtcctcgacctccgaggtgcagacgaagatcagctcgtcgccggcctccagcgggtcgtccggcgtcggcaccaccacgcgcttgccgcgcaggatggccaccagcgcggcatcccgcggcatcggcaccgaacgcaacggcttgccctcgtacggcgcgttgcgcggcagcgtgatctccaccaggttggcctcaccctgccggaaggtcatcagccggaccaggtcgccgaccgtgaccgcctcctcgaccagcgcggccatcaggcgcggcttgctgaccgccacatcgacgccccactgctcggtgaacagccactcgttctccgcccggttcacccgggccaccacccggccgaccgcgaactcggtcttggccagcagcgacaccaccaggttggccttgtcgtcgccggtggccgcgaccaccacgtcgcaggacgccacgtcggcctcctccaggctgctgacctcgcaggcgtcggccagcacccactgggcctggggcacccgctccgggcagagctggcgcggctgccgctcgatcagcatcacctcgtgaccgttgccgatcagctcctgggcgatcgagcggcccacgttgccggctcccgcgatggcgatccgcatgtcagtgcccctcgtttccggcgcgcccggcgatgtccaggactttgttcacggtgtcgtcggtgaccagcgcgaagacctggtcgccgtcctgcagcacggtggacggctgggcgagcgcggccatcccgaaacgcatcagataggccacccgggcgccggtgccgtcctccagcgccttcaccgtccgccccacccagtcgctgtggatcggcacctcgatgatgctgaccacgctggtcgggtcgcggaagacctcgttgtgggcctcgggcaccaggtagcggaacatccggtcggcggcccagcggatcgtcgccaccgtcgggatgccgagccgctcgtacacctgggcccgcttggcgtcgtagatccgggcgaccacccggtgcacgccgaacgtctcgcgggccagccgggccgagatgatgttcgagttgtccccgctggagaccgcggcgaaggcgtccgcccgctcgatcccggcggccctcagcacgtcccggtcgaaaccgatcccgttgaccgtgatgccgccgaactccgagcccaggcgccggaacgcgtcggcgttctgatcgatcacggcgacttgatggccccgcgtgtcgaggctgtgcgcgagcgtggagccgagccggccacaccccatgatcaccacgtgcacggttggtgccctcccgaatcgcctacggtccctgttgagcgtgccatgcccttctgcggcgcggtgtccggggcgggctacgcgaaatgacgcccggccgtacccttggcactcgtggcaagtaccacctccctagccaagcggctgcttctgggccggccgttccgttcggacaagctgcaacacacgctgctgccgaagcggatcgcgctgcccgtgttcgccagcgacgccctctccagcgtggcgtacgcacccgacgagatcctgctgaccctctcgatcgccggggcaggcgccttcgcgatctctccctgggtgacgctcgcggtcgcggtggtgatggtgaccgtggtcgccagctaccggcagaacgtgcacgcctacccctccggcggcggcgactacgaggtggccacggtcaacctcgggccgcgcgccgggctgggggtggccagcgcgctgctggtcgactacatcctcaccgtggcggtctcggtgtcgtccggggtgaagaacctcgcctcggtgctgccctgggactgggtgggcaacgaccgggtcgagatcgcggtcggcgcggtgctgctgctgaccgcgctcaacctgcgcggcctgcgcgaggccggtctggcgttcgccatcccgacgtacctgttcatcctggtcaccgtcgggatgatcctgaccgggctgttccgcgtctacatcctcggcgacgacctgcgggcgcccagcgccggcctgcagatcaccgccgagtccagccacctcaccagcttcgccttcgtcttcctgttgttgcggacgttctcgtccggctgcgcggcgctgaccggtgtcgaggcgatctccaacggggtgcccgcgttcaagccgccgaagagcaggaacgccgcgaccacgctgatgctgctcggcggcatcgcgatcgtgatgctgttcgggatcatcgcgctggcccggatgacccacctgcagtacgtcgaggaccagaccacccagatcatctccgggccggccaactacgagcagaagacggtcaccgcccagctcgccgaggccgtcttcgggcacggctcgggcctggtcgtgctggtcggcgcggtcaccgcgctgatcctgttcctggccgcgaacaccgccttcaacggcttcccggtgctcggctcgatcctcgcccaggaccggtacctgccgcggcagttccacacccggggcgaccggctggcgttcagcaacggcatcctgttcctggccggcgtcgcgatcgtgctgatcgtcgcgttccaggcggagccgacccggctgatccagctctacatcgtcggcgtcttcgtgtcgttcaccctgtcgcagggtggcatgatccggcactggaaccggctgctcaagattcagcgcgatccggagcgccgccgccagatgatccgctcccgggcgatcaacgcgttcggcatgggcctgaccgccgccgtgctgatcgtggtgctgatcaccaagttcctgctcggggcgtggatcgcgatcgtcgcgatgatcgtgttctacgccctgatgctggccatccaccggcactacacccgggtctccgaggagctgcagccgaccgaggaacgaccgacgctgccctcccgcaaccacgcggtggtgctggtcagcaaggtgcacctgccgacgctgcgggcggtcgcctacgcccaggcgacccggccggacacgatcaccgcggtcaccgtcaacgtcgacgacaaggacacccgggccatccaggccgaatgggagcgccgcgagctgccggtccagctgaccgtcatcgactcgccgtaccgggagatcagcaaaccgatcatcgactacgtcaaaggcgtgcggcgcgcgtcaccgcgcgacgtggtcacggtcttcgttcccgagtacgtggtgggccgctggtgggagaatctgctgcacaaccagagcgcgctgcggatcaagggccggttgctgttcgagccgggggtgatggtcaccagcgtgccgtggcagctgcggtccagccaggaccgggacctcgaccgcctggaccgtggcctgagccgggcgccggcgcgggggccgcggttccaccccgaggcgacggccgttcccgatcagccggccgaggagaaatcgtgacgtcgcccgtcgtctcacccgctgatgatcttgtcgagggcgaccggatcgagctgaccgtgggggcgccggcgcacggcgggcactgcgtggcccgtttcggcggcccgcacggccgggtggtgttcgtccggcacgcgctgcccggcgaacgggtcaccgcggagatcaccgaacggcaccgcggatacctgcgcgccgacgccgtcgagatccacgaggcgtcgccggaccgggtcaccccgccgtgcccgtacgcccaccccggcggctgcggcggatgtgatctgcagcacgtctccggcgacgcccagctgcgttggaagacgcagatcgtccgcgaacagctggcccggatggcgaacctgcacaccgacgacgatttcgtccgcgtggaacccctccccggcggcctcctccactggcgcagccgagtgcggtacgcggtcgacgccgccggccgacccgggctgctccagcaccggtcacaccaggtagtgccgatcgaccggtgcctgatcgcccacccggccatccaggaactcgacctgctcgcccacccgtggccggacgcggccgcgctgcaggcggtcgccaccaccggcggcgacgtcgtcacccagcaacgcccggccgcgacctccggcgacccgaccgccttcggcgaccccaccgaggctgccggcggcgccggactggtccgtctcaccgggccggaacgggtcaccgaggtggccggcggccgccgctgggacctggcgcccgactcgttctggcaggtccacccggaagcagcggccacccttaccacggcggtgctggacatgctccggccggctccgggcgagaccgcctgggacctgtacggcggggcgggcctgttcgcggccgccgtggccgcccggaccggcgcccgcaccaccatcgtcgagtcgtccgcgctcggcgtcgaggcggcccgccgcgccctggccgacctgccgtccgtcgaggtggtccaggccaccgtcgagaccgcgctgacccgccgccggatcaccgggcctgtcgacctggtgatcctggacccaccgcggtccggcgccggcgccaaggtcgtccacggcctggccgccgcctccccccgggcgatcgcctacgtcgcctgcgacccggcggcgctggcccgggacgtgaagacgttccgctcgctgggctgggagctggccgagctgcgcgccttcgactgcttcccgatgacccagcatgtcgagtgcgtcgccctgctcctgcccgcctgaccgcccggccggctcgtcccgctcgccgtccccgaccctcccggcgcgccgtcactcgtgctgccgggtcggactgcccggcccctcgccggcaccgccggaccgcctggttcccggcggccggcgggaccgccctttgccgcgccgccggatggcctggttcccggcggccggcagggccgccctttgccggcgccgccggatggcctggttcccggcgggcggcgggaccgccctttgccggcgccgtcgcacggcctggttccccggcggccggccggttccccttcgccggccggctcccggtgtcgcctcggggcgtggtgacgaccggaggccggcggaggaaccggggccggcggcgtggtcccgcgtgagccgccgctccggcgcggaccggcgctcacggtcgtctccgggcgcggtgccgaccgcgtgggccggccgtgaccggggtcaggggttggcgcgctcggccgcggcgacagcgttgcggaacagcatggccaccgtggtggggccgacgccgccgacccggggggtgatcgcgccggcgacctcggcgcaggactcgtcgacgtccgggagcaggcggcggccctcgtagcggacgcccgcgccgatcaccgtggcgcccggcttcacgtgctccggctggatgatgtgcgggacgccgaccgcggcgatcaggatctcggcgcgcctggtgtagcgcggccagtccttcacaccggtgtgcacgacggtgacggcggcgttcgcggtgggccgcttctgcgccagcagcatggcgagcgggcggcccagggtggcgccgcggcccaggatgaccacctcacggccggcgacctcgacgccgtggtgggcgagcagcgcctcgatcccggccggggtgcaggggagcgggccgggcaggccgaccgcgagacggcccatgttgagcgggtgcatcccgtcgacgtccttgtccgggtcgagggtctgcagggcggcgtcgtagtcgaggtgggccgggatcggatactggatcaggacgccgtgcacgctcttgtcgtcgttgaactcggcgatgacctggagcaggtcggcctgggtgacgtcgccggaaagatgccggtgcggggactcgaagcccagctcggcggcctgcttctgcttgatccggatgtatccggcgctggcgtcgtcgtcgccgaccaggatggtggccaggctgggctggatgccgcgctccttgagcttggcgacccggtcgcggacgtcggccaggacggcctcggcgacgggcgcgccgggcaggaggcgggcgccggttgtctcggtggtcatgttcctcatgctcctcggccggggagcccaggcggtcgactcccgtgacgagctccccgatggttcggaccatcctcgtgccgccagtcgctgcttgcctccaggatgccggatccgcggtcccggtgaagcggcggggtcattcgacagccggtgcgaacgcgcggcggtggatcgcgcgcggcggtggatcgcgcgcggcggtgggacgtgcgcggtggtgggccgcgcacggcggtggtgggacgcgcggcggtggtgggacgcgcggcggtggtgggggcgcgacggtgcccggcccggcggctgtgggccgtgcgaggcggccgtcgtcggcggtcacagggcggtcggagggccggcgagcggcgaaggcggagcggaagcggaagcgggggaggcggcgtcgacggcgggtggtggggtgccgccggcgtgcgggtcgtcgtcgaaggtggattcgtcgaacggcgcttcgccggacagcacccgggccgcctggtcgcggtcgatctcgtgggtccaggtgccgatgaggatggtggccaccgcgttgccggcgaagttggtgagggccctcgcctcggacatcaggcggtcgatgccgacgatcaggccgacgccgggaaccaggtcgggccggtggctctgcaggccgccggccagcgtggcgaggccggcgccggtgacgccggcggcgcccttggacgcgacgatcatgaaaagcagcaggccgatctgctggccgatggagagcggccggtcgagggcgtcggcgatgaacagggacgccatggtcaggtagatcgcggtgccgtccaggttgaacgagtatccggtgggcaccacgatgccgaccaccgggcggctcaccccgaggtgccccattttggcgatcagccggggcagcgccgattcggacgacgaggtggacaggatgagcaggaattcgcgggccaggtagcgcagcagccgcccgatcgacactccggcgaccagccgcagcagcagcccgagcaccaggaagacgaagatcgcgcaggtcacgtagaagccgaccatgatcgcggcgaggctcttgagcgcggcgaagccggtggcgccgaccagggcggccatcgccccgaacgcgccgatcggggccagccacatgatcatcgcgaggatcctgaagacgacccgctgggccagcgccaccgcggcgatcaccggttcgccgcgggcgcccagcgactgcacggcgaatccgacgagcagcgccaccagcagggtctgcagcacctgggtgctggtcagcgcggagatcagggtgtccgggatgatcccgaggacgaagtcgacgccgccctcggccgttctgctcacctgggcggtgccggtcttggcgagttcctggctcaggtgcaggccggcgccggggtgcaggatgttgccgacgatcaggccgatcgtcagcgcgacggtggacatgatcaggaagtagccgagggccagcccgccgacccggcccacctgggcggcgcgccggatcgagccgacgccgagcaccagcgtgcagaagatcaccggggcgatcatcatccggatcaggccgacgaatccggtgccgagcggcttcagcttgaccgcgaagtcggggaaggcgaagcccaccgcgatgcccagggccatcgcgaggagcacgcagagatagaggaggtggctgcggtcccggcgccgcggagcgggggcatcgacggacatgcattgatcttacccctgtctgtgaactgaatcacagctcagtgccggacctccagccgaacggggaatgtgcaggtgctgtggaggaatcggggctgaccgttcgctccaggtcgcgcgcaggcgccaccccgatagactcctccctcatgagcgactccccttcgaccccggccggcctgctggcgagcgtcaccggtcccggtgctctcaagcgactgtccgcggagcagctgaccctgctcgcggccgagatccgtgacttcctcgtggccaaggtgtcgaagaccggggggcacctcggaccgaacctgggcgtggtcgagatgaccctcgccatgcaccgggtcttcgactcgccgcgcgacaagatcctcttcgacaccggccaccaggcgtacgtgcacaagatcgtcaccggccggcaggacggtttcgacctgctccgccagcggggtggcctgaccggctacccgagccaggcggagagcgagcacgacctcatcgagaactcgcacgcctccaccgcgttgtcctacgccgacggcctggccaaggcgttcgcgctgcgcggcgaggaccggcacgtggtggccgtggtcggcgacggcgcgctcaccggcggcatgtgctgggaggcgctcaacaacatcgccgccacgaagaacaggctggtcatcgtcgtcaacgacaacggtcggtcgtacgcgccgacgatcggcggcctggccgaccacctctccacgctgcggctcaaccccggctacgagaaggtgctcgacctggtcaaggacgcgctcggctcgaccccgctggtcggaaagccggtcttcgaggtgctgcacgcggtcaagcgcgggatcaaggacgcggtcagcccgcagccgatgttcgaggacctcggcctgaagtacatcgggccggtcgacggtcacgaccagcaggcgatggagtccgcgctgcgccgggccaaggggttcaacgcgccggtgatcgtgcacgcggtgacccgcaagggctacggctaccgtcccgccgagcaggacgaggcggactgcctgcacggcccgggcgccttcgacccgcagaccggcgcgctcaccgccaagccgtcgctcaagtggaccaaggtcttcgccgaggagctggtgaagatcgccgacgaacgccccgacgtggtgggcatcacggccgccatggccgagccgaccggcatcgccgctctcgccaagaagtaccccgaccgggcgtacgacgtgggcatcgccgagcagcacgccgcgaccagcgccgcgggcctggcgatgggcggcctgcacccggtggtggcggtctacgccaccttcctgaaccgcgctttcgaccaggtgctgctggacgtcgcgatgcatcggctgccggtgaccttcgtgctggaccgggccggcatcaccgggccggacggccccagccactacggcatctgggacatgagtgtcttcggcgccgtccccggcctgcgcatcgccgccccgcgggacgccgccaccctgcgcgaggaactgcgcgaggcggtcgcggtcgacgacggcccgaccatcgtgcggttcccgaccggtgcggtcgccgcggacaccccggcggtgcgccgggtcggtcaggtcgacgtgctgcgcgaggcggagaagaaggacatcctgctggtcgcggtcggctcgttcgtcggcctcgggctggacgccgccgagcggctcgccgagcaggggtacggcgtgaccgtggtcgacccgcgctgggtgcgcccggtgccgatcgagctgaccggcctggccgcccagcaccgcctggtggtgaccctggaggacgggatccgcgccggtggtgtcggtgacgcggtggccgccgcgctgcgcgacgccggggtgcacgtgccgctgcgcgatttcggcgtgccggccggtttccacccgcacggcacccgggccgagatcctcgcctcgctgggtctgaccgcgcaggacgtcgcgcgggacgtgaccggctgggtgtccggcctggacgccggcacgtcggtggcggccccggcgatctgaccgacgcggtggcgagcgtctccgttattcaaccgttatctttgacggatgggtgcggagacggtcatcgacctcggtctcgaccggggggttccggagtcctacgagcgaccccggcgggccaccgtcccgcagtggttcgccccggtgctgctcgccctgctgctgctgatcagctccagcgcctcggccgccccgccgaaacccccgttcaccccgctgctgcggatcccgatgggcccggccgatccgtatctgatcaccgcggccggccgcctggtcacccagaccggcgacgtggtcaccgcctacgacctgacctccggggcgctgagctggcgggccggccggtccaccccggtcctgcggctgcgcaccggcgacgggatgctgctcatgcagccgtggaccatcggcggcgcggcggccggcaccaccgcgatctcgctggccaccggcgagcggcagtgggtcaatccgcgcagcgtgatcaccttcgcgggcagtgacgcgctgatcgcggtgaccggcacccggagcctgtccggcagcggccgccgggtgcagggtttgatcgaggtgctggacacgctcaccggggacacccgctggcgggtccgcgtgccgtccaccgcggtggttctcggggtgcccggcccgtccgacgccggcgcccggatgctggtggtccgcgacgaccgcacggcggtcctgcacgacgtggcggacggccgggtgctggccacccgggagctgccgtcggcgaactacggcccggacaacccggtggtggccggcggcacggtgctgctgcggcatccgggcgtctccgggatggaggtctccgcgtacgacccgctcaccctgcgcccgctgtggaccgaggaggccgacggcaccctcgatgtccgcccgtgcggtttgctggcctgtctgctcggtgggggcggggtgcgcgccgtcgacccggccaccggggaccagcggtgggcgcagcgcggctggcaggcggtcgagcagcggggcaccagcctgctcgcctaccgggaggccgacggcgcgctgccggccgccctggtggacagcgcgaccggccgggtgctgaccgacctgaccggatggcgtccgctggccggggcgaatcgggccggccgcctgctcgtcatccgggcggtgccggacggcgcgcgtaccatggtcgcggtcgccgacccggtcggcgggcggttgcgcacgatcgccggcctgccgcccggcaccggcgggtgcgaggccgctccggaccggctggtctgccgttccgcggcgggtgaactggtggtgtggtcctacgacgagacggccggtgcgcgctgatccggtgggccggaaaagccgtatcaggaagtcgtgaaagcacgacgtaccggggaaagggtgtgcggtggccctgatcgatctggaccgcgtcgccccgcccggcccgccgcgtgccgcgcgtcccccgatccgcgcctatcggcgtggcggcctcctgcttgccctggtcctgctcaccgtgctgggtggcgccgtgcccgcggccggcatctgctggcgctatctcggcgcgatcacctcgccgctcgccccggacgggccgatcgagctggccggcggccgggtgtacacggtgggcacggccggcgctgatccggtggtgaccgcctggagcacggacgacccgccgcggcggctgtggagtgtccgcgccccggtcggcgccggcccgggtgtggtcccgccgtcctcggtgaccgtccgtccggccggtgacgtcgcgctgctgaccgccggggtggccaccaccgcggtcgacgccgcctccggccggatccgctggtcgtcgccgatcgcggtgaccgtgctggccggcagcggcatcggcgtcacggtcgaccgggtgttccgcgccggcacggtgtacgaccaggcgtccggcgccccgggcccgctctacttctcggcgaccggcgagccgcacaccgagccgccgctgcgcaccgacgtccgcggcctggacctggccgacgggcacaccgtgtggacggtcgcgccgggcggcgcggtgacggtcgaccaggtgcccgggccggacccggccgtgctgatcacctcgtcggcccggctcagcctggtctccgggcggaccggcgagccggtgcgccaggccgacctgccccggttgtccgggcacgggccggccggtggcgcgctgctcggcgacgtcgccctggtcagctatcagaacccgggccggcaggtggcgtaccgggcgcgcaccctgcagcggctctggtcgcgcccggtgccggatctggtcgccgacccggcggactgccagggggtgctctgcgacggcgggcacggcaacctgcgggtgctcgatccgggcaccgggcaggcccgctggcggaccggggaggacgtcgacctggcgatccgcgccgggtacgtgctggagaccgacgccgcctccggtgaaccggtccggctcaccgacccgcacaccggggcgaccgcggtcgatctggacggctggtcggcaccggtggccggggcggccgacgcgccgctgctgctgcgccgccgggacgggcacggcgggcaggcgttcgccgccgtggtccccggccacgcggcggtccgcgagctgggctcggccggggtccggctgggcgactgcgacgcggacgggcactatctggcctgccgctccccggagggactgcggctctgggcgtaccggatctgagtcgcacggccgcccttccgggcgtgacctggcttgcggggtcgaagtgcgcggacgctcctcgacagtctcggagccaattcgatggtcggctggtggggacatcttgagacgcggcgcagcaggctcttcctgcttgatcgtcatcgtctcggtggacgaaccacatggtcggacagggcgatcagctggtatctggctagacaccttacctgtgggtcgtcgccgaccagggcggtgacgaccgggcgggcctcgcccggtgagtgagccaggaaagccggccagccggcgccgtcctcatcaccgcggtcttcggcgacggatttcgtgtccaccgacattgttcatggcgcgcgggtagggcgtggacgttgggctccatccagcgggccagaacggcgctcataattcgcctgaccggctgcggccggcgacactgggatgtccgaatgcaacggggcgcccggctccctgctcttctagcaacagcggaatggtcgcctgttccaggttcgacggagccgcactgcttcattgcgatgagtcgtcaacgctcatcagttgtgcactcggacggccactcattcgaacgttcgtttgaaatagggcgtccacgctggccgcgccggtagttgctctgggcgtgacaacgcgtcgtgtgagacacgttctcctcacaagaggatatcaatagacgtttagagagactgctcggtgtaacagagatctgcggcgtctgattcttcctgaagagctctgtagaactcctcgcgttcactgtcgtccatggtcggccttaccgctgaagcttctctggggtcagcctccgagcgaaaagcaaaaaccattcccggctcaagcggtcctggtgtatcgaactctcgttgcacagcgctctccgggatcctgtctggtcttcctcgctgcgccgggatcttcggtgcctgtcgcttctggcggttggcgaggagatcacggattgcattcacggcatgcttacccttcgggcaacggaggatcttcggatcagcaacgcgttctaagcgatgtcattccaatgagcgacttcacggagatagactcgcgtcctgactgtgcgtaggacgatcaagctgacagccgtgacgcctcccaccaaccctaacaatagccagccagcgtccacatcaggaagagtccagatcccgactaccccctgatcatgaagtgtcagatgagcttctgcccacgcctgctggcgacgttctaggatatagagcatcgcactcgcaaccgaaacgaattgggtaatggccaatccgacatatgttgctaatgaagattgacggacgcgctccatactgtatcccacccaggcggccatcgcggcgggtgccgcgagaaggagagctgccgcatcggacgagacctcggtaacgctgggtcgcaagaatgcaaaaactgccacgagtgctgtagtcaccatggcaacacgagccacgcctccaagggcgcctggagggacctcggcgaattcaacgatcgaggctagtgggtcctgggatttcgcgtcgatgcgggcgaatccgcgagaatacaatcgagcgtaagggaggccggttcgatatcgaagccggagatagcaggcagcatagcggccctccatgtcttccgctcggaggaactcttgcttcgcggtatgcaccacttcgtgattggcgacatattgcccggaagtgcctctcatggagaagtggtacgaagctgcgcggtagatcaatggcatgggaattttgaatttgtacggaagaaggccgcaccgcacccgcacccgttccctgaaatttgccaccaagccataaatgggcaatgtctggcgatactggagatgaaccctattggtgggggcgtcaacgggcacgtccacagctaccaagtaatgtcgggaataatacgtgcacagctgctccagtcgactgccgaatcgcctcgccgcaggcgtactcgtcaggatgaccccgctcacgatgccgcgaaactcctgctcagacgcctggtccgatgcgcgcccgcgcctataaaccattctcagaagcgcatttagagcgagaggccttttggagcggtcgagtagctcgtccaaggacacgttataagctttgctgtagcaggctattattgcatgcgctagcaggccccgagtctcgctttgcggcagagtgggaacgacagcgtcgtccgctgaaacaacttcgaaggaatccagaagtgtgcccttgcgagcttcgatcacgggaacgggtatcagcgatgatccctgcgtagagggcgtaaaggtgcggtccagggcgtaatctatagacgtctgacatgctagactttgatctagtagttgaatctcgtcgtaggctctgacaagaagtctattgtcgagcagcaatttactgaaaagtaccttggcttgattgtccttgtatttggctgccacggcggcaatgctgcgttggatttcgtcatcgagcgcattgtcgcctgggttgtccggcttgggcctgccggggccgccgcccagtctttgcggccaggccacgaatatcagcgcggcagcaagcagggcggcgacgatgccgaagaagaaacgcaaggttgcttgcgccggacccggcatttcctctaacggcccgtcgaagatcgccatccatccgagcaccagggcggcgattacaagaagcgcataagcgatcctcttgggcttggtgtcgagattcaccgcgtgcgctccctccggccggtcgaatattcctatcgcgatagcgttatgggatcaatcaactacttggcgtattgacgaccggcaggcgcaagaagaggcaaagcgggcatagtgtggaaagtcccttgattttcattcggatgggtgcatagccagtgtcttcgtttttaagtgttgaccatgtaatccgtcggtttggtgccgcttgaggaaggctcttttccgcgccgttattcggggtggtcagatgctcgaaagtgtccgtacggccgatgcccgatggttagcggcttcggaaggagagggagccacccggcaagcgcgacccgctacgaccaactcgcggcgcgctgccagagagtcctaactctcaagatcatttgcaagtggctatcacctgctttcgagacacgcccttgtagcctgcacgtacgccctcgtctgatggaggaactgcggtgcgcgtgctggtggtggaggacgagcggacgatggccgacgcgatcgcccgcgggctgcggcggcacgggatggccgtcgacgtcgcgtatgacggcgcacagggccacgagatggcctacgtcacccggtacgacgtggtggtgctggaccgggacctgcccggcatgtccggtgacgagatctgcgcggccctggtcgactcgggtgcgctgacccgggtgctgatgctgaccgccagcgcctcggtcgccgaccgggtcgagggcctgcaactgggcgccgacgactacctgccgaaaccgttcgccttcgacgaactggtggcccgggtgcaggcgctgggccgccgggccaccccgcccgccccgccggtcttcacggtcggcaacctggtgctcgatccgggccgccgggcggtcacccggggcgagaccccggtggatctgaccaacaaggagttcggggtgctggaggtgctgctcaaggcgagcggcgcggtggtctccagcgaggaactgctggagcgggtctgggacgcgaacaccgacccgttcaccaccacggtccgggtgaccgtgatgaccctgcgcaagaagctgggcgatccgccgctgatcgacacggtggtcggggccggctaccgggtcgtgaccacatgaccgtctatcaggggcagccggtccagcaccgggagagcttcctgcgccggctggcccggcccaccctgcggctgcggctcaccctgctgaacgggatcctgctggtggccgccggcgcggtgctggtggtgctggcctggttgctggtcgacgagccgctgcacccggccgacaggctgcgggtcgggtcgagtgtgacgctgaacgacggcaccacccgggaggcccggtcctggcagaccgagaccatcgacgaggcctccgaccagttgctggtcaaggggctgagcgcgctggtggcgatcagcatcatcgggatcgccggcggctatctggtgacccgccgggcgctgcggccactgcaccaggtcacccagaccgcgcagcggctcggtgaggagacgctggaccagcggatccggtatgccggggcggacgacgaggtggccgagctggcccgcaccttcgacgcgatgctggaccgcctggccggcgcgttcgagtcgcagaagaggttcgtcgctaacgcctcgcacgagttgcgcaccccgctcgcggtgatgcgcaccgagatcgacgtgacgctcagcgacccggacgccgacctggccgagtaccgccggatggcccgggtcgtccgggacgcctccagccgggcgaacgggctggtcgacgcgctgctggtgctggcccgttcggaggcgcagtccggccggcgactggtccgcaaggtgccggccgacctggccaccagcgtgtacaacgcgttgtcggcggtgaaggaggaggccgagcggatgcggctggaggtcaccacggacctggccgcggccccggtggtgggcgacccgagtctgctggaccggctggccggcaacctgatcgagaacgccatccggtacaaccacctgctcggccggctgtggctgcgcaccgtctcggtggacgggcaggcgcggctgatcgtcggcaacaccgggcacgaggtggagcaggccgaggtgcccgggctgttcgagcccttccgccggggcggctgggagcggaccgggtcgcggggctccggcctgggcctgtcgatcgtgcgggccgtctgcgacgcgcacggcggcacggtgtcggcgatcgcgctggccgacggtggcctggaggtcaccgtctcgctgccggccgccgacaccactccggtggtggcggcgaccgccagcgtgccgaggggccggagctagccgaccttctcgatttcggcgcggatcgcggggaactgcttctccgcggcgctcttggacgtgtagtaccacacgagcatgccgacgctgcccgagtcggaccaggcgcagacggcgaccgggaccgaggagaccttgccgtcgccgcacttggccgagccaccgaacgagccggtgtccaccgcggtgatgtgctcggccgagaagccggtcgtgctcatgctggtgaagttgcggtcgagctcgagctccgggtcggagatcggcgcggccaccgcgatcgtcatcaccatgttcttcttcaccggggtgccgtagaacgcgccgagcgacttggtggcgcccgggtagccgtccttcagaccctcctgcatggtcttggtgatggtggcgaactcggcggtggtgagtttcggccggccgcccagtgtcttcggctcgacgacggtgatgtcggcggccggcttggccgcgccgccctcggtggccttggtggacgaggtgctggtggccgtggcggtgcccttggacttgtcgtccttggcgagcaggttgatcgcgaccacgccgccgacgcagagcaccagcacgatggcgatcgagatcagcgtgatcggcagcgccttcgacttcttcggcgcgggcgggatcggcgggaagctgggctgcggctggccgtaggcgggctgaccgtaggccggctgctgctgaccgtaggcgggcggctgctggccgtaagccggctgctgctgcccatagggcggcggctgctggccgtaggccggctgctggggctgcgggtaggcgcccgggaacggctgggtcggcggcaacccctcctggggcggcacgttcgggttgggcacgccggggaacggctggcccgggtaggggtcctgcgacatcgactaactccaagttgagggaacgcgccgcagcctatcggcccggtgtgacaaaataacgcccccgcccgggttacgggcgggggcgtcggaaatcggtcaggaccggcgaacgtccgccagcccgttcggcaggaaacgctgaccggtgatctgctccgcgataccgctccggtccaggtacggcgtgattccgccgaggtggaacgggtaaccggcgcccaggatcatgcacaggtcgatgtcctgcgcctcggcgacgacaccctcgtccagcatgatccggatctcctcggccagcgcggcgagggccttggcccgcacctcgtcgccggtgagcacggtgtcgccgacctcgagcagcttcaccacgtcggcgttgatctcgtcgtcgaccagcagcggcaggccggcgtcgacgatccgcttcaggttggggctgtccacgtaccgctccgggaaggcgcggtgcagggtctcgccgacgtggtacgccacggccgggccgaccagctggagcagcgcgatcgggcgcatcggcaggcccatcgggtcgaacgcctcgttcaccacctcgagcggggtgccggcgtcgaccgccttgaagacctcgctggtgaaccgggtgagcacccggttgaccacgaacgccggggcgtccttgaccagcaccgaggacttcttcagctcgcggcccacggcgaacgcggtggccagcgtcgcgtcgtcggtctgctcgccgcggatgatctccaggagcggcaggaccgcgaccgggttgaagaagtggaagccgacgacccgctccgggtgctgcaggccggccgccatctcggtgatcgacagcgagctggtgttggtggcgaggatcgcctccggcttgacgatggtctcgaactcggcccagatcttcttcttcaggtcgaggttctcgaagaccgcctcgatcacgaagtcggcgtcggcgaacaccgacttgtcgaccgagccgctgatcaggccgcgcagcttggccgcggtgccctcgtccaggcggcgcttgccgaccagcttgtcgatctcgccggtgacgtacgccacgcccttgtcgacccgctcctggtccaggtcggtgagcacgaccgggacctgcaggcggcgcaggaacagcagggcgagctgggaggccatcagaccggcgccgacgatgccgaccttggtgaccttgcgcgccagggacttgtccggcaccccgaccgggcgcttggcgcgccgctggaccaggtcgaacgcgtacaggctggcgcgggcctcgtcacccatgatcaggtcggcgagcgcctcggtctcggccgcggtgccgtcctcgaacgtcgcctccttggccagagccagcagctccagagccttgttggcggacgggaccgcgccgtgcagcttctcgtcgagctggttcttggcgaaccacagcacgccgtcccacatgtcccggtcgatctccgggcgctcgaccgtgacctcgcccttgaccacgccggccgcccaggccagcgagtcctcgaggaagtcggcggcctcgaacagcgcgtcggcgacgcccagctccctggcctgcttcgggcgcagcaccttctgggtcagcgggttctgcaggatgacctgcgccgcgccggcgatgccgatcaggttcgggagcagctgcgagccgccccagccggggatcaggccgatcgcgacctcgggcaggccgagcgcggtcgcgccggaggagacggtgcggtagtggcagtgcagcgccacctcgaggccgccgccgagcgccgcgccgttgacgaacgcgaaggtcgggatggtgctgttccggagccgggcgaacacccggtgccccagctcgcccagctcgacggcctgctcccgggaggagagcagcggcatgccggtgatgtccgcgccgacgcagaagatgtagggcttgccggtgaccgcgatgaacgccgggtccgccgcgagagccccggtgatcgcctcgtccagcgactggagcccggccgggccgaagctgttcggcttcttgtggtcgaagccgttgtccagggtgatcagcgcggccggcttgtccagcccgggtacccggacggaacgcagcagcgccttggtcactacctcgttcgggttctcgatcacttcttgaagccttcccagttcgggttctcccagatcacggtgccacccatgccgataccgatgcacatcgcgttcatgccgtaccggacctcggggtgctcctcgaagtgccgggcgagctgggtcatcaggcgcacgccggaggaggcgagcgggtggcccacggcgatcgcgccgccccacgggttgacccgcgggtcgtcgtcggcgatgccgtagtggtccagcagggccagcacctgcacggcgaaggcctcgttcagctcgaacaggccgatgtcgtcgatggtgaggccggccttcttcagcgccttctcggtcgacgggatcgggccgtaacccatgatctccggctcgacacccacgtaggcgtacgacaccagccgcatcgcgaccggcaggccgagctcgcgggcggtggcctcgtcggccagcagcgccgcggtggcgccgtcgttgagaccggccgcgttgcccgcggtgatccggccgtgcgggcggaacggcgtcttcagcgtggcgagtttctccagcgaggtctcgcgcggcgcctcgtcgacggtggccaggccccagcccagttcggacgagcggatcgcgaccggcaccaggtccggctgcagcttgccgttggcgtacgccttggcgaccttgagctgcgagttgagcgcgaagaggtcggtgcgctccttggtgatgtgcggcagccggtcgtgcaggttctccgcggtcgcgcccatcaccagggcggacgggtcgaccagcttctcggtcaggatccgcgggttcgggtcggcgccctcacccatcgggtgccggcccatgtgctcgacaccaccggcgacggcgatgtcgtacgcccccatcgcgatgccgccggcgacgttggtcaccgcggtcatcgcgccggcgcacatccggtcgacggcgtagccgggaaccgtcttgggcagtccggccagcagggcggcggtccggccgatggtcaggccctggtcgccggtctgggtggtggccgcgatcgcgacctcgtccacccggtccgtggggagctggggattccgcttgatcagctctcggatgcagcggatcaccaggtcgtcggcgcgggtctcggcgtacatgccgcccgccttgccgaacggggtgcggacgccgtcgacgaagacgacctcgcgtacttcacggggcacagcaagcctccaatgcgggcgtgaacccaaatgtgtgaagaatgctactcgccagtaactagcgggtgccaggcccgtgccgaaatgtcacagcgccgtttccgcgagcctcaccatcggccaggcgaggcgtggccggagagtttccgggaagaagataaagatcaatttccaggagctttgtgcctacgtccgccggggtccggatcgccgctcccgcggggaccctcccgatccgagcagggcgctgcgcgcccagaacgctcagaccgagagggcgacgtccgtgggtggtcgcggtcagtgcacgaccctcgtggttctggagctctccagtttccgtgggtggtcgcggtcagagcacaagacccgcgaccgcaagatggtcagtcggtgaagggggcgggcaggacgccggcgagctggccggcgatgaggccgacctgccagttgcgggcaccgaagccgcgcagcgtgtcgctcaccgtctgcgccgagacctcgtccggcggcgaccaggccagccggcggatgaagtccggactgatcaggttctccgggggcagccggtaggtctccgcggtgccgaccaccacctggcggcagcgggccagccgggccgcggcgatcggatcccgttcggcccaccggtgcggcgggggcggcccctccaccggctggttcaccggcagcgcgtcgtccggcagtgcccgcgcctggtccagcgcgtccagccaggtcttgaccagccggcggaccgaacgcccgccgaagcccgggatggccagcagggtccgctcatccttcggatcggcctcggccgcggcgacgatcgccgagtcgggcagcacccggccgggcgccgagtccttccgggcggcgatcgcatcccgcgcgtaccacagcgcgcggacccgggactgcgcccgcgcacctcgcacccgatggatgccggaggtgcggcgccacgggtcgggccggacccggggcggccggtcggcgctggccaccagcgaggcgaactcctcggctgcccagccggccttgccctgcttgtccagttcggtggcgagcaggtcgcgcaggtcggtgagcagttccacgtccagcgccgcgtaggtcagccaggactccggcagcggccgggtcgaccagtccgccgccgagtggtgtttctccagcgagtagccgagcaggtgctcggtgagcgcggccaggccgacccgctcgaacccggccagccgggcggccagctcggtgtcgaacagccggcgcggcttcatccccagctcggcgaggcacggcaggtcctggctggcggcgtgcagcacccactcggtgtcggccagggcggtgtccagggtgcgcaggtcgtccagcggcagcgggtcgatcagcacggtgccggacccggcccggcgcagctgcaccaggtaggcccgctgggtgtagcggtagccggaggcgcgttcggcgtccacggcgacggggccggagccggcggccatccgggccaccacctcggccaggccgtcggcgctctccaccggggcgggggtgccatcgcggggcgccgtcaggggaacagcctcggaaccgccagaactcgggtcgggcggcacggcgtgcggtccgtcccctgctgactccggcgcgtcccgacggcgcaggggtgtttcgtcggtcactccgtaaccgtacgggggtggcccccctgccgtgcgcagccgggtcccggcgcgccgattctcgatcgacttccgggttcaaccattgcgcggtttgctccgtatacccgggtgccacgccgacaccacccgggaggccgtgcggatgaccgccacctacgagcccttcacccccgagccgcgccgccatcgcgccgaggagtcctggggcggtcagtaccagcgctgggagccggccgcgccggagccgcggtggccgcaggagcatccgcagtggccggagcaggcgcggtacgaggagccgcgcccgcagtggcaggagccgccgcgcttcgaggagccgcgcccgcagtggcaggagccgccgcgcttcgaggcgcccgccccggcttacgaagcggtgccggcgaagcccacggcgtcgaaggcccggccggtcgtgatcggcctggtcgtcctcctgctgctggtcatcggctggcaggcgtaccggatcgaatccgtgatcaagagcagcaacgacctggccgccgcggtcagcagcgagcagaaccacagcgcggatctgcagaagtcgctcaccggcgtgttcgacccggagggcatctccaccgccaccctgcccagcgtctaccgggtccgggccggcgacttcaccggcaccgccttctcggtcggcaccaaggcgaagagcggcaccgcgaacctgctcaccaacttccacgtggtcgagtcggtgtacaaggccggcacccggaccgtccagctggagcagggcagcacccggatcagcgccaccatcgtcaaggtcagcgagaccaaggacctggccctgctggtcgccaagaagaccatcaagccgatcaaggtggccaccaccaaggtcaaggccggtcagcagatcgtcgtgctgggcaacccgctgggcctcgacgacaccgtcaccaccggcgtgatcagcgcgttccgcgagaacgacgcggacgggccgaccatccagttcgacgctccgatcaacccgggcaactccggcggcccggtggtcaacgccaaccgtcaggtggtggcgctggccaccgcgaaggcccgcgacgcggaaggcatcggcctcggcatcccgatcgccaccgtctgcgccctgttcgacgtctgctgacagccggcctcaggtcgccggggcgcgatgccggtcgctcagcgacgacaccccgggcggcggcaggcccgcggtcgaggcgagcatcgcgcaccacccgtacagatgggccgtgacgtcgtccgaggtcggcgtccaggacgcgcgcacctccaggtcggcggtcggcgccggcccggccagctcgccgaaccgggtcgacgcggtctgggtgatcgtcccgccgatcgccgtgcacgccgccgcgtgctggtccagcgcgtcggtcagccacgtccaggcgaccgccggcagcagcgggtcggtcgccaggtcggcttccagctcggcggtgaccagggtgaccagccgcaggtcgccgcgccaggcatcgtgcccggccgggtcgtgcagcaggatcagccggccgctggccacctcctcgccggagcggagcacggtggcactgagcgcgaacgagtacggcgcgagccgctgcggcgcggcgatctcctcgagcaggatctccggccggggcgagtccgcgcgcaacgcggtcaccgcacgggtgaacgcctcgggaacagcggagggggacgccatggaggaagagtatgccgatctccgcccgggccgccctcgccgcgccgccgggcgtcgctcactcacgtggcacgatgacccggtgacggttctcgacgattccccgttcgtccgcgcgtgccgcgggctgcccggcccgcacacgccggtctggttcatgcggcaggccgggcgctccctgccggagtaccggaagctgcgcgaggggatcggcatgctcgactcgtgccgccgccccgacctggtcaccgagatcaccctgcagccggtccgccggcaccgggtggacgccgccatcctgtacagcgacatcgtggtcccgatcgcggcggccggcgtcgatctggacatcgtgcccggcaccggcccggtggtcgccgagccgatccgcaccgccgccgacctgcagcggctgcgtccgatcaccgcggacgacgtggactacgtcgccgaggcggtccggctgctggtcgccgagctcggcgccaccccgctgatcggcttcgccggggcgccgttcacgctggccagctatctgatcgagggcgggccgtcacggacctacctgaagaccaaggcgatgatgtacgccgagcccgagctgtggcatgccctgctcgcccggctggccgagatcaccctcgccttcctgcgcatccagatcgacgccggggtgagcgcggtccagctgttcgactcgtgggccggcgcgctctccgaggccgactaccgcgagttcgtgatgccgcattcggcgcgggtgctgcgtggcctggacgacgccggtgtgccccggatccacttcggtgtcggcaccggggtgctgctggaggcgatgggcgaggccggcgcggacgtggtcggcgtcgactggcgcaccccgctcgacgtggccagcaagcgcctcggtccggacaaggccgtgcagggcaacctcgacccggcgatcctgttcgccggctgggacgtcgtcgagcgcgaggcccgccgcgtcctcgcccagggccagtcggctccgggtcacgtgttcaacctcggccacggcgtcatgcccgagatggaccccgacatcctcacccgcctcaccgcgctcgtccacgaggcatccgcacgctgagttcatcggctcacagcggcggaccccgggtgccggggtgcgcggcgggctgggagggtggaggcgtgcggaagcggatcgcggttgtcggcggcgggatcgccgggctggcggccgctgtccgcctgcgggacgtgacgcgggcggacaccgagatcatcgtgtacgagcagagcggcgccctgggcggcaaactgcgcaccggtgagctggccgggctgcgcgtcgagcggggcgccgagtcgttcctgaacggttcgccggacggtggcccgtccgcggcggtccggttcgcccaccgggtcggcctcggtgacgccctggtgcacccggcggcccagccggcagccctggcgatcggcggggcgctggcccggattccggccggcaccctggtcggcgtgcccggcgacctgtccgcgctggacggtgtcgccctgccggaggcggacgcggacgccgacaccggccacccgctgctcgccgccggtcaggacatcgcggtcggcgagctggtccgctcgcggtacggcgccgaggtggtggaccggctggtcgacccgatgctgggcggggtctacgccggccgggcggatcggctgtcgctgcgggccaccatgccgcagctggcccgcaccgcggagaccgagcacaccctgcgcggcgcggtccgggccgcgcaggcgctgagccggcgcaccccggggcagccggtgttcgcggccgtggacggcgggatgagccggttgatcggggcggcggcgaccacggcacgcgcccggatcagtctgggactgccggtgcgcgggatcacccgtaccggcaatcgatggcatctgaccctggggccggcaccgcagccccagaccgacgaggtcgacgccgtgatcctggccgtgccggcggcgccggcggcccggttgctcgcggatctcgcgcccggggccgcggccgcgctcggcgacctggagtacgcgagcgtcgcgctggccgggatggcgctgccgcccggcacgcggctgcccgagctgtccggcttcctggtgccgccgggggaggggacgctggtcaaggccgcgacgttcttcacccggaaatggccgcacctgaccgggccggacggtccggtgatcgtccgggcgtcgctgggccgggccggggagcaggagcggctgcagctgagcgacccggcgctgctggcgatcgcgcaccgggagctgagcgagctggccgggacgcggctgccgtcgccgaccgcgtcctggatccagcggtggggcggtggcctgccgcagtacgcgccgggtcatccggatcgcgtggcggccgcgcgggccgcgctgcctgcggggatcgcgctcgccggggcggctctcgacggtgtcggcatccccgtctgtgtggccagcggggagcaggcggcggacgatgtgaacagttacctggaggcaagtgcatgagcgagcagaccaatgcggctcggatcaacgagctgaacgccaccatccgctacacgatgtggtcggtcttccgggcgtccagcccgctgccggccctgcgcgacgagctggccggcgaggtcgacaccctgttcgagcagctcgcggcgaaggatgtgacgatccgcggcacctacgacgtgtccgggctgcgcgccgacgccgacctgatgatctggtggcacgccgccgactcggacgacctgcaggaggcgtactcgctgttccggcggacagccctgggccggcacctgaccccggtctggtcgcagatggcgctgcaccggccggccgagttcaacaagagtcacctgccggccttcctcgccggcgaggaggcgcggccctacctgtgcgtctacccgttcgtccgctcctacgagtggtatctgctgcccgacgccgagcggcgcgagctgctcgccgagcacggccggcaggcgcgtggctacccggacgtgcgggccaacacggtggcctcgttcgcgctcggcgactacgagtggatgctcgcgttcgaggccgacgagctgcaccggatcgtcgacctgatgcgtgacctgcgggcctcccgggcgcgccggcacgtgcgcgaggaggtgccgttctacaccggccgtcgccgctcgatcagcgagatcgcggctagcctgccgtagcgggacgggccatgggtacgtgggggatgccgtcctccacgtactccgggccggtgggctcgaaaccgtaccggcggtagaagccgaccaggtacgactgggcgtccagcaccgccgggcggtggccgacgacctccagggcgtgcgccatcagccggccggccagtccggcgccgcgggccgtcttcgcggtgaccacccggccgatccgttccgtcccatggtcatcgagaatccgcagataggcccgaatctcccgatcacgggagaaccataggtgtcgggtaccgggctcggtgtcgcggccgtccaggtcggggtaggcgcagttctgctcgaccacgaacacgtcactgcgcagccggaggatgtcgtacagcgtgccggcgggcaggtcgcggaaggacgcgacccgcagctcgtcatgcggtgcggggtgcatcggcacagcgtatgcggcgcgtcgtcaccaccgtcgccggtcccgcgttgtagtgatgaggctacggcctgtggaggacgcgatgatcaagcgcagcaagttgttcggcaacaagacccgggtgaccttcagcctcccggcggacgagccgtccggggtggtcagtgtggtgggcacgttcaacgactggcagccgggccggcacgagctgcaggtgcgccgcaacgggacccgcacggtcagcgtgccgctggacccgggggagtacgaattccgctacctggcgaccggcggcgtgtggttcgacgacccggagggcagcgaactccgcctataagcgtttcaccgcgtgcggtgaggagatgtgctggagtccgtcaaccgactcccgacgaagggcacatcgtggcagacgtcaagctcgcgatcatctactactcggccaccggcaccctgcacaggatggcgcaacgcctgcaggaggcggccgagaaggccggtgccgacgtgcgcctgcggcaggtcgccgagctcgccccgcccgaggcgatcgcctcgaacgcggcctggagccagcacttcgacaccaccaaggacgagccgcgggccgccgcggacgacgtggtctgggccgacgcggtgctgttcggcacgcccacccggtacggcaacgtggccagccagctcaagcagttcatcgacacgctgggcccgcagtgggcgcagggacagctggcgaacaaggcgtacgccgggttcaccgcgtcgatgaccgagcacggcggccaggagtcgacgctgctggccctctacaacacgatctaccacttcggcggggtggtggtggcgcccggctacaccgacccgctgaagttcgccgacggcaatccgtacggcgtctcgcacgtcaccggcggctcgaacgacgcgccgctcaccgacgtgcagtacgccgccctcgatcacctggcgcgccgcatcgtccagatcggtggccgcctgcgggcctagtaggttctgcgtatggccgtggacacgcagtacgaagatcttctccggcgggtgctggagaccggcacccgcaagagcgaccggaccgggaccggcacccgcagccttttcggcgagcggctgcgctacgacctgtcccaggggtttccgctggtcacgaccaagcgggtgcacttcaagtcgatcgcggtggagctgctgtggttcctgcgcggcgagacgaacgtgcagtggctgcgcgatcagggcgtgacgatctgggacgagtgggcctcggagtcgggcgagctcgggccggtctacggctaccagtggcggtcgtggcccacgccggacggccacgtggaccagatctccgagatcctggacacgttgcgtaccgatccggactcgcgccgcatgatcgtctcggcctggaacgtggggcagctcgacgagatggcgctgatgccgtgccacgcgatgttccagttctacgtggccgacggccggctgtcctgccagctctaccagcgcagcgccgacctgttcctcggcgtgccgttcaacatcgcgtcgtacgcgctgctcacccggatggtcgccgaccaggtcgggctgaccccgggcgacttcatctgggtgggcggcgactgccacatctacgacaaccacgtcgagcaggtgcgcgagcagctcggccggcaggcgtacccgttcccggcactggagatcgcgaagcggcccagcctcttcgactacgagtacgccgacttcaccgtcgtcggctacgagcaccacccggcgatcaaggcgccggtcgcggtatgagcgtgcacctgatctgggcgcaggcgcaccgccgggtgatcggggcgggcggggacatcccctggcacgtgcccggcgagcaggcgatcttcaaggagcggaccgccgggtcgaccgtggtgatgggacgcgccacctgggactcgctgccccggcggccactgccggggcggcgcaacgtggtgctcacccgcgatcccgggtggaccggggacggggcccacgtcgtacacagtccggatctgattggcgaagttgacttctgggtgatcggcggggccgctgtctaccagctgtttctgccggtcgccgagcacattgtgcggacgtcgatcgagctggacgtggagggcgacaccttcgcgccggagctgggcccggactggaaggtgaccgcctccacggggtggctgaccgcgccgaacgggatccgctacgtggtggaggacctagctcgggtctagcctgatcgacaggctgttgacgcagtgccgcgtgttcttgtcggtgaagccctcaccccggaacacgtggcccaggtgcccgtcgcagcgcgcgcagcggatctcgacgcggaccatgccgtgggtgcggtcctcgatctccttgaccgcgcccgggatcgcgtcgtcgaaggacggccagccgcagtggctgtcgaacttcgtgtcactggggtacaactccgccccgcagccgcggcaccggtacatgccctcggtcttggtgttcacgtactccccgctccagggcgcctcggtgccggcctggcggagcacccggaactcgtccgggtcgagccggatccgccactcgtcctcggaggtgggcagggtggtctcatcggttgccatgccataaaccgtacgtcggaacgtgtcgcacccggcgtgcggcggcgcaccgggccgggccgttgagccgtctatggaagctgcatccccgacgttccggccgaccttccagcaggctttcggccacggcctctatctgggcgcgctcagcgcggtggcgagtgtcacgacgggggtgatcgccaccgtggtctggcccgggccggtcggcccgccggcctggtcctgggcgctgctggtgctggcgccgctggtgctcggcgtggtactcgggatcaccctgggtcgacgcaccggggtggaggtcggcagccgggagatccggacctcgtcgctgctcggcgagggcgaggtgccgtggaaccgggtggtggacctgcgcgctgagcggcgcggccggcgcaacgtggtctcggtgtatctggattccggggcgagcgtgcagctgaacgccccgtacagcgggggactgttcgccgccgacccgcagttcgagctcaaggtattcgctttgtcgcatctgtggcgcagccaccgtttcggtggtcttccgagttgatgacgcgccggagggtcttttcgggtaaaacgggcaatccccgctaagctcccgtgcgaccatgcaaacgtacgcaacagcaacagaacggatactcctcatgagctttgttcgtcgactggccgtgggaatccccgctgccggcgtcaccgccttcgctgcgctcgccatctcgtcgcccgtcctcgccgcgtccttcgacgccgcccacccggccgtgcacgccagcgccgaccgcggcaacgcgggctacggggccgcatcgccggcgaccaccacaccggccgccaccgcgccggccgccaccacaccggccgccggcggtccgaccgcgaccgtcgtggcgaccacgccgccggccgcctagctagctagacaccgtcgggggcacccgcgggcacgccggatacggcgaggtgagcccgaccggtggcgccaagaccgtgccgggcggggtgagcccgaccgaggtgccgtcgccgatcaccaccaagggcagcggggtcagctccggctcgctgccgctgaccggccgcccggtgggcgcgaccgtcgcggtcggcgcggtgctggtggccggcggcgcgggcgcgctgtggtacacccgccgacgcaagtccgcctgattccgtctatgtccgatttgtgagggtcacccggttttgtcgggtggccctcacgtttttcggccgcgcggcctggtgcccgggccagactcgtggcgccgggtccgtgcccgcctcgcagcgccacacacccgggtcttcctcgcggcgccacctccggctcccctttccgcggcgcgcccgggttggttcttccagggcgcgcgcggagggtgttttcgcggcgcttgggttcgtccttccgggggcacgcgcgggcggtcttttcgcggcgcgcctaggttcgtccttccggcggcacgcagggcttgtcttcggcggcacgctcgggacttccttttggcatagggtcggggcatgccgaaagccgctgccgaggaacacgagatcgccggccacccggtccgcctgagcagccccgacaagatcgttttcgccgaacgcggcttcaccaaacgcgacgtcttcgagtattaccgttcggtcggcgacggcatcctgcgcgccctccgcgaccgaccgaccaccctgcaacgcttccccgacggcctggagggcgaagcgttcttccagaagcgcatccccacccgcggcgttcccgagtggatccggaccgccaccatcaccttcccgagcggccgtacggcggacgagctctgccccgccgacctggcccacgtcgcctgggccgcgcagatgggcaccgtcgtcttccacccgtggccggtccgcggcggcacccccgaccaccccgacgaactccggatcgacctggacccgcagcccggcctcggtttcagcgacgtgaccgcggccgccgaggtggtccacgaagtcctcgacgacctcggctgggtcggcttccccaaaacctccggcggccgcggcgtgcacgtgtacatccggatcgccccccgctgggatttcgtccaggtccgccgggccgccatcgccctggcccgcgaggtcgaacgccgccgcccgcaggcgatcaccaccgcctggtggaaggaggaacgcggccagcgtgtcttcctcgacttcaaccagatggcccgcgaccggacaatcgcctgcgcctactccctgcgagccaaccggcgggccaccgtgtccaccccggtgacctgggccgaactgcccaccatcaccccggacgacttcgacctgcgcaccgtcccccaccgcttcgccaccctgggcgacccacacgccaccatcgacgacgtccaccacgacctcaccccgctcctggagtgggtcgaccgcgacgagaaaaacggcctgggcgacatgccctaccccccagaccaccccaaaatgccgggcgaacccccgcgagtccagccctccaaaaagaaccccgccaactggcagtcctaacccccagctactctccacggccgctctccacggccgctctccacggccgctctccacggccgcccggcaggggccggccccaccctcgaaccccagccctcgcactcttcgccgccgtcccgcccacatccagcgacgcttccaccatcgcgtgcggcggtgtcttgccggtcgtcgcgcgtgcgtgggtgtcctgccggttgtcacgtgcgtgtgcggcagtgtctcgccggtcgtcgtgcgtgtgcggcagtgtctcgccagtggtcgtgcgtgtgcggcagtgtctcgccagtcgtcgcgcgtgtgcggcagtgtctcgccagtcgtcgcgcgcgtacgcggagccttcatggtggccgagcacatgcgcatattcgatggaaaatctcctcaaggcaaccctcaaaaattgacgcaaacatcttcagggagccgcccgcaaaatatctattccagatgaaatgtctaccattattaagctcgaccaccgcccagtgaccacaacgaactcggcgccaactcacctgagcgagtgtcacctggaccaccatcacacgccagcccaccaaaacaataaaaatcccagcgcgcccacacccgaccgcaagccgcgcatcaccagctgtgttggggttgggtgcgaccttccgcttgatcaccctagctagctagcggaaccgaattcgctggtcccggcctcgcatcagccgccgctggagggagcggttcaccgcaaggcgcaggcctcgaaaccggaccggctggccgaagccgggcaccaaccccctgccgccgttgatcgtcctgagcggtgacggccgcccacgcctccgccgcactccacccgttgcggaccagcttccgtgtgtgcctttgtcgcaatccccacgcgcgatgccgctcatgttgccgccggaattcctctttctccggcgaataattccgcgccgcagtgcggtcccgcatccgcgcgacctcagcccggctgaacaacgacaactgccccactccccaattatcccgcccccgagaagagaagtgtaaggcccgtcaagtgccaaaaaaaagattctcgcgcccgcaccgaggaaacgagtgccgggtgctgggtggccgacgaatatgcggccccgccgtcgccgcggaatggtggtctggtgcgaccagtggtggccttcggcgtcggttcagtcgacgcgagtttcagagtatgagtttcatgccgacatgcgaggcggtgaagccgagccgttcgtagaagcggtgcgcggccacccgcttgttgtccgacgtgagctgaaccattgcgcagccgcgttcctcggcccgggcgatcgcccagcgcatcatggccgcgccgtggccgccgccgcgcaggtcggcacggatccggaccgcctcgatctgcatccgccaggcaccgccccggctcagccccggcaggtaggtgagctggcaggtgccggccaccaccccatcctggaccccgacgatcaactcgttgtgcggatccgcggcgatcgcctcaaacgccgcccagagggccgccccgatctccgccggaacctcgccgaacccacgaccgcgactgatctcatcgtccgcgagcagagcgagtacggcaggaacatcttcacgaccagcaacccgaaactccatgatcaccagtctcccagccgcctatccagcgttcctaggctggaccaccctaggatccggcaaccccgggaccaaactgccctacctgccacaactgcgtcgaacgcgcgctacgtcaggcggctggaccccgagcttccgctgcttggggcgtgctgcctgacgaccgtgaaattcgctgcgtgggggcgtgctccgaaggcggcgggtgtggcaccgaatgtgtggaccttcgggtgtacgcggcgccgccgcgcgatggctcgcctgcttcgggtgagccctgtcttgaggctgagatgtcctaggacgggcccaccctaggacggccccaccctaggacggccccaccctaggactgggcgatcctaggacgggaccaccctaggactgggctgccctaggagtgggctgctctaggagtggtggaacgagccgacggtcagcaccccgtgaaggtgggtgtgggctgccctaggactgggctgccctaggactgaaggctcctaggactgagctgtcataggctgcgccaacctgggtctcgccgcccaccgggtggatggggctcgcacggttgaccgtcgcccctacgtcggccgtcgtctgcccgcaggcgcggctcagcccgacgggcccgcgagtggggctgccgctggtcgagactacggcccttcagcccggcattagcgagaacgggaactcgtcgtcgagcgatgtcagcgaagagcggtagtccggtcgcatcggcagtaagcggaccggaagcatcgacgaccggcggaaaccggccgtcggcggcgatcggcggacagcaagcgtcagcagccggcggataccggccgtcggcggcgatcggcggacagcaagcgtcagcagccggcgtataccggccgtcggcggcgatcggcggacagcggacagcgagcgtcggcagccggcggataccggccatcgggggcggtcagccgacagcggacagcggacagcggacgtcggcagccggcggataccggccgtcgggggcggtcagccgacagcggacaccaagtatcggcggccggcggaatccgacggtcaggaggcgtccactaccggcaggatccggccgtcgggcggcggccagcgcacagaaagcgtccgcgaacagcgaaaccccgtcagcagatcctcgggagccttcagcggacggcgaagccggccgccaagggtcgccggtcagcggatcgctgcgaccgccccccaggcagcgccgacgtgcccccaggtcacttggccgggcagcgcaacccctccttgggcacggtcaggttcagcaggtagccgtcgaccgcgctggtgatgcagggcgtcgacggatacgcggtgtggccctcgccctcccaggtgagcacgtgcccggtgcccagcatggcggccaggtgggcggtgttctcgtacggcgtggccgggtcgccggtggtgccgacgacgacgatgggcggggcgcccttggcggccccggtcgggtacgggtcgcgtttgccgggccagtaggtgcaggggagcatgccgatggcgatcggggcgccgaacatcgggtatttcttgcgccactcggactggtatttgcggacctggtcgacggtgggtgcgccctcggtgtcggagcagttgacggccaggttagcgtcgaacaggttggagtacgagccatcggccttgcgctcggcgtactggtcggccaggtccaggatgcccttggcgtcgccgcggccgaggtcgcggatggcgtcggcgaggctggtccagccggtttcggtgtagagcgaggaaatcaccccgacgaagatccacccggcggtggcgctgcggccgtcgcggtatttgaccggggacttctccgcattcgccatggcggcggtgaccgcgccgcgcgggtcggcggagatcgggcatttcgccggggtcgcctggcaccacttggtgaagttgccgaaggcccgctcgaatcccttggcctgggtttccgagctggtcacgtaatcctcggtggcgtcgaccgcgccgtcgaggaccagggcccggacgttctgtgggaacagctgggcgtaggtcgcgccgagcagcgtgccgtaggagaagcccaggtaggtgagtttcgggtcgccgaccgcggcgcgcagcgcgtccatgtcgtgggcggcctgctcggtggagaagttcgccagctggtcgccgtatttctggccgcagccatcggcgatcttcttgttcagcgccgtgacctggtcgaactcggcctggctgaccgggtcggggtcggagccgaagctggcgtcctgctcggcgtccgggatgcatttgagcgggctggaccggctcaccccgcgcgggtcgaagccgacgatgtcgaacctgtcggtgatctccgtgggcaggccgttgaaaccgggcccgaacgacaggtagacggcgaggtcgacgccggagccaccgggaccgcccgggttgaccagcagcgagccgatccggtctttctgcgacttggcgcggatccggatcatggccaggtcgtacgtctgaccggagtccggtttcgcccagtcgcgggggaccgcgacggtggcgcagtcgtagttgaccccggcggcgccccggccgacgagtttcgtcggcacgtcgggacacggtttccactgcgcggtgccgccggccgcggcggccgatgcgccgccgcccggcgtggccgggtcggtggaaccctccggcgcgaacgccggcagtgtgcaaccaccggcggtcatgaccagcacggcgaggagtgcgaggaccgaacgtgagcgacgaggcacggcgccaccctagccggtccgtctgacagtcccgctcagcggctggtgagaacctcggcgagatcgaaccggacggggcgctccaactgctcgtacgtgcaggtgcggggctcccggtcgggccgccagcgctcgaactgcgcggtgtgccggaaccggacgccctccatgtagtcgtagcggacctcgacgacccgttccgggcgcagcgggacgaacgacaggtccttgccggcgttccaccggctcacctcgttcttgcgcggggtgcgttcgccctgctggtgggcggcccagtcccaggggtgcccgtcgaagccggtgaccagcggctgcatctggtcgaacagctcctcgcggaccttcatcgggaacgagccgatgaccccgaccgaggccagcacgccgcgctcgtcgtagaggccgagcagcagcgagccgatccggttctccgccgacttgtgcacccggtacccggcgaccacgcagtccgcggtccgcttgtgcttgatcttgaacatgacccgcttgtcgggctggtaggtgagctcccgtcccttggcgatcagcccgtccagcccggcgccctcgaactcctcgaaccaccggcgcgcggtgtcggtgtcatcggtggccggcgtgacgtacaccggcgcctcggcctggcccaacgcctgccgcaagcgttcccgccgctgctcgaagggcagctcggtgaggtcctcgtcgccgagcgccagcaggtcgaaggcgacgaagctggccggggtctgctccgagagcagcttgacccggctggcggcggggtggatccgctgctgcagtgcctcgaagtcgagggtgttgcgaccggtgtcggcgacgatcacctcgccgtcgatcaccgcccgctccgggaagttggccaggaccgcctcgacgacctcggggaagtaccgggtcatcggtttctcgttgcggctgccgatctccacctcgtcgccgtcccggaagatgatcgaccggaagccgtcccacttgggctcgtagatcaggccgggcgggatctccggaacgggcttggcgagcatcggcttgaccggatgctggatcggcagctgcatccgctcagtctgcccggaattctcgtcgggggaagcctttaccctgccacggggagagactccactatcgatcgcatggactggacacgacagactcgattctccgacccgggccggcaccgcgagcggctcgccgcgctgcccgccgacgccgacgcgatcggggccgtggtgcgcaacctgaccgtgcactaccgcgcctccggcatcgacttcccgccggagcggctcaccgacatcgacacccggtgggtgagccggatgctcgacctggacgaggagcggttcggtggcgcgccgctggacgccgaccggccgctgcagcagcggctgaccggctgctgccgggacagcgcgctgctgaccgtggcggcgctgcgggcgcaccggatcccggcgcggagccggatcgggttcgccggatatctcgaaccggattaccacgtcgaccacgtcgtcaccgaataccacgacggcgagcggtggatcgccatggatcccggcctcggcattcccgaggtcgagctcggcccggccggtctgcacaccgccgcccaggcctggcgggcgatgcggcgcggcgagatcgaccccgggacgtacggggtgggtttcggtgtcccgatcggcgggccgtggatgatcctgcactatctgatgctcgaactggcccaccggcagggcgacgagctgctgctctgggacctgttcggcgaggcgatcccgtttgccgaccgggagtgggcgctgctgcccgcggcgttgcccgccgatctcacccacctggacgagatcgccgcgctgctgctggacgccgatgcgggagacgaccgagcggagaaggaactgactgcgcggtacgtcgatgacccccggctgcatccgggcggaaccgtcttctgcgtctcgccccgcggcgcccgttacccggtcaccctgacctcagtgcaccagtagcccgacgagtcgctccagctcggcggccggttccacggtgaggcccatgtggaccggcccggcccgcaggatggtgctgcgcggggcgaccagccagcggaaccgctcgccgagccgcatcccggccgaggcgccgccgccccggcaggtggcctcccaggagtccagggcggcgcggacggcgggcacgtcggcggacgggtcgagggccagcagccgggactcggtcaggtgggtgcgggccgagaggaagtcgtggcgctggcagtagagcagcaccccgacgttgatcagctcaccgcgctcgacccgcggcacggcctggatcaccgcgtactcgtaggggatcctcatggcagccaggcctccggacgctcggcgcggcgcgcgaggtggtcgaggtaggcttcgcggtcgccgtcgtccagccagtcctgcgggaccagggcgaccacctcggccagcaggtcgcgggtgagccgggcggccagcgccgggccctcggtggccagcgcggtggcgtacggcttgagcacgtggtcctcccaccggtaggggcggtgcaccaccgcctcggcccgcgcccagtcgtggtggaagtacagggtggcgccgtggtcgatcagccacaggccgccgtgccagatcagcaggttcgggttgcgccagctgcggtcgacgttctccacgtacgcgtcgaaggccagcacccggctggccagcccggcctcgaccgggtgcgcgttcgggtcgtagccgagcgcgccgggcaggaagtccatccccaggttgccgccggcgctcgccttgatcagctcctggacctcctcgtccggctcggcccgggcgaccaccgggtccagctcgacgcgggccagctccggcaccggcaggccgaggcggcgcgccagctcaccggcgatcacctcggccaccagcgctttcggtccctgcccggcgccgcggaacttcaccacgtacgtcccgaggtcgtcggcctcgacgacgccgggcagcgaaccgccctctctcaggggcgtcacatacctgatcgcggtgacctcacgtagcaccgggtcagcttagtgggccctgtttccgcaactcgtcgaccttggtcatggcgtcgcgcaggccggccagccactcctcggtgtgctcgccgaccagccggacgcaccaggccagcgcgtccgagcgggagcgggccacgccggcgtcgacgagcgtgtccaggacctggcgctcgggttggcgcagccgggtcatcaccggcgcggacaggtgcgtccagagctcgtcggcgctgccgcagcggacgccccaggcgaccttgcgctggtagcggtgctcgacctggcgggcgacccggattcggtcgtcgcgggtgttctcccggaactgggtgatccgtccggcgagggcggcggcgcggtcggcgtcggtggcctcggccggcaggtccggctcgggcagccggccccagatgatgatctcgtcgcggtcggtgacgacctcgggcggctcggtgaaccagccgtccgggacggcgccggtgatccaggcggcggcgtcgtcggcggcgggcgggtcggtaggccggaaacgcatctcgtcctcctcggcaatctgtggtgattacatgcttacatcgcaatcacgtaagtcgccagtccggggagttgagcagtcgctcaaaacggtctacgctgcgatttgagcggtcgctcaaacggggggcggccgctctcaacgggaagggaagatcatggaagactcacgcttcaccagggcgaacctcctgttcgtcggcctgatcgcggtgttgggggtgggggccttcttcaccgccgtgcaatccgggcggcaggacagcgcgttgctcttcgtggcttttccgaccgtgctggctgtgctggtggcgctgtatccgaccggcaccacccacggcacggtcttccgcttcaccacggtcgccctgctggtctgcgccgtgcagctgcatgagggggcgatctgcgtggtgctcgccgcaccgctggtctacctggtcgcgcacggcgtcaccgggctggtccggatgtcgaaacggcgcggcaaccacctgtatgcgctgctgccgctgcccctcctgctggtcggcagtgcggaggggaccagcggcgacctccggatccacccggaccagtcggtcgaggtcacccgcgtggtcgccctcgcacccgaccaggtccgcgccgtcctggaggccggcccgcagccgacagccacccgctcgctgccgctgcgcctgctcgacgtcccggtgcccgagcacgtgcacggcgacggcctggcccccggcgaccgctggaccttcgtctaccacggcagctcgcacggccccggcggcgacatcgtcacccgggtcaccgatgccgggccggcccgggtcacctggagcgtcatcgaggacacctcgatcaccggccgctgggtcgggatgcgcgacgccaccctgacctggcacaccgtcccggccggcacctcgatcacgctgcgcgtcgactaccgccgcggcctcgacccgagctggtatttcggcccgctgcaggacggcctgatgcacgccggcgccgagcacctcctcgacatgctgtcgctgcgatgaccctcgtccggtacgcgtcgctgctgctgcccgccgcggccctgctcgcggccgggcggtatccgaaggcgagccgccaagaccgcgccggtgcattcctcgcgttcctgaccaccgccctcgggatcgccgtcctgcacgaggtggccacggcgtccggctggtggcggttcgccccggccgacggcgcctaccgcgggatgccggtcgacctgtggctgggctgggccaccctgtggggtccggtccccacgctgctgcatcgacacgtacggccgcaatatgctcttgccgttctgctctggctcgacctgatcacgatgccgcgcctggaaccgctgctgcacctcggcccgcactggctgctcggcgaggcgctcgggctgatcctgatcgccctgccggcgcagctgctcgggcgctggacggccaccggccggcacctgcagccgcgcgtcatcctgcagatgatcctgttcaccgggctgatcctctggctgctgccgaccgtcgtcttcaccctcggcgacgggggctggaatcacctggtcgccctgccccgctccacgctgaccgttctggcccaggtggcggcgctgctcggggtgcccgcggtcgccgccgtgcgggagttcgcggtgcgcggcggcggcaccccgttcccctgggatccgccggtgcggctggtcaccaccgggccgtacgcgtacgtcgccaacccgatgcagctgagcatggtcgccgagctggccctgctggccggggccacgcacagcctggcgctgggcgccgccacgctcggcgcggtcgccttctcgaccgcggtcgcggcgccccacgagcacggtgacctcggcgaacggcacggggaggggtggcgggcgtaccgacgtgaggtcgtcgactggcggccacgcggacgcccgtacagcgccatcgcctctgcttcgatcttcatcgacgacgactgcggcccgtgcgcggcgacccgggacttcctgctccggcgcgcgcccgtacggttggctgtcgtgcccgccgccacccacccgacgacgctgtggcgagcgcggtacgccgcggacgacggctactccgccgagggtgtggcggcggtcgccgccgcgttcgatcatctcggcatcggctgggcgtacgccggatggttcctgcgcctgccggcggtgaccgcgctcgcccagctgatcaccgacgcccagatcgccccaccccaccccgccggaggacaacggtgagcgacaccaaacaacggctgctcgacggcgccctggccgcggtccgcgaccacggcgtgaccgggacctcggcccgcaccatcgccgccgcggccggcgtcaaccaggccctggtcttctaccactacggctcggtcgacgaactgctcggcgcggcctgccggcaggccaccgaggcgcgggtggcgctctacgccgaccggttcgccgcggtcaccacgctgcgcgaactgctggaggtcggccgcgacctgcacaccaccgaactggcccagggcaacgtgtcggtgctggcgcagacgctggccgcggcgcagaccaacgagcggctggccgagccgatccgggccaccttccagctgtggaccgacgagatcgagaaggtgctgcgccgggtgctggccggctcgccgatcgccgaggtcgccgacgtgcccgggctggcccaggcgatctcgtcggcattcgtcgggctggaactcttcgagggcatcgacccggccggcgggcaccgggccatggaggcgatcgaccagctcgccgtgttggtcgaggtgatggacgaactgggtccgctggccacccgggtgctgcggtcccggatcaaaaaagccggcaaaaagtaggactcacaggacgaaggcgtccgtccagagctgccgcgagcgaccggacagcgcctccatcagccccaccgcctgcccgtcggtcagcccggccacgaagtcgaccaccgcgcgcccgcgggcccgaccgatccgctgcggggtgtccgccggcagctccgactcggccagctcgaccagatcccgcagccgccgcggcagccggtccgcctcgtccggatcggtcagccaggccagcaacgcctccaccagcgaggacagcagccgaccctgcccgcgctggtgcagcgccaggtcgggacgggccagcacgaacctgttctgcacgaacttgagcacctgcacctcgtgccactgcgccacggacagctgcacgtgcccgctgcgcaccgcggcctgctcggtcaactccaccgagtcgaccagccgccgggtccaggtcgccgagaacgccgccacccgcgcctcggcctgcaccgacccgtcgaacggctgggccagcagcccgtccaccagctcggcccggaccaactccaccgcgccggcgaacgcgtcgtcgtcggcgatccagccctccttgcggtgcaggctgcggcgcagcgactcgatcgccccgccggcccggcgcaggtccgtctcggcgccccaccgctgccacgccatcaactcggtggcgaccgcaccctgctgcaacacgccgacccgatgcacatcttccaggtcatggatggcgtacgcgatgtcgtcggccgtgtccatcaccgacgcctcgaccgtctgctgccagtccgccacccgcccggcgaacggcgcccgggccgcccgcacatcgccgacctcggtcgaataggcgctgaacttcgtcgaaccacccgccggctcctccgggtgggcggccgccccgcgcggcggcggatccatgaaccgggggtgcggctccggatagtcgtgccgggtccacggatacttcaggatcgccgcccgggtggcgttcgtcaggttcaacccgatcgtggcctgcccgcggatctcggtgctggtcacgatccgatacgactgggcattgccctcgaaaccgtccggcaggcccagccgctgccgggccagcctgtccagcacccgctcacccagatgcccgaacggcgggtgccccagatcgtgggcgagcgcggcggcctccaccacatccgggtcacagccgcccagcttctccgccagatccggctcggcggccccgatccgctcggcgatcgcccgggccacctgcgcgaccttcaaactgtgggtgagccggttgtgcaccagcagcccggccccgccggggctgatcacctgggtgaccccggcgaggcgggcgaagaacggggagctgacgatccggtcccggtcgacacggaacgggctgaaagccagatcgccgggggcaaccgtgctgtcgccgaaaagtcgctgggcgcgcggatcgtccatcccggggagattaccgggactgcagcgcgtccaacgcgacggccatcgcggccaccaggcgacggtccaggttcggctcgtggatcgcgacccggtaggtgtcccgcaggccccacttgcgctccaccgagaacgccggccggccgtcgaccacgaagtcgaagtggtacggcagccaggacagcgagtccacgaaacggcgcaggatcgccacgaacgcgttccgctcctggccgacgatctccggccagcccggctgctccagcacccaggtcgagcgcagcagtgacgcgccgaacttcttgcggaacaggccgatcaccacgccggccgcgtcgaacacgtcgtaggtggcgcccaggtcgatcacctggcgggccttgaagcccagcaccggcacctgcttggtgtcatcggtgtacagggtcacctgctccttgaacgccagccgcttctgctgcgcgaaggcgaggatgccggcttcctgcccgtccggggtcaccgcgtggacctcgtactggttcaccatcaaacgaatgcgctggcgcacgatcaactgcgactgcgcctggaggatatcgatcgtcaccgcggcagtgtgccatacccgtcatccgcggcataccggccttcaggacgaccctgccaggcaaatcagcgcatgtccgaccgccgctccggcatctctcccgcggccgccgcgccggctcccgttcgcccgctggccgcgttggtccctcgttgctgaggagcacctcagctacccggtgggcatcggccgcccgatcgggtcagactgggcgcatggcgaagcgtgttcgtacccgtacggtggtggctctggcgctcggcgccgcggcggtctgggccgcccgcgacctgcccgcgcagatcggcgcgagagcgagcggcgcccgccgcatgcggatggagtcctccccgcagttctccggcggcagattccgcaacacggtcccggccaccgaggtcacggccgcgtcgatgccgcgcctgttcgtcgccgcgatgaccgaccgtgacgcccgccgcccgcacctgccggtcccggtggtcaccccgcccaccgccccggccccggccgacggcctgcacgtcacctggtacggccactcgtccgccctggtcgagatcgagggccgccgggtcctgctcgacccggtctggagcgaccgctgctccccgtcccgcctcaccggcccccgccgcctgcaccagccccccgccccgttgcgcgagctccccccactcgacgcgatcgtgatctcccacgaccactacgaccacctggacatgaccagcatccagcacctggtcgacctgcaggccgccccgttcctggtccccctcggcgtcggcgcccacctggagcgctggggcgtccccgagtcccgcatcgtcgaactcgactggaacgagtcccaccggatcggcaccctggaggtgatcgccaccccggcccggcacttctccggccgtggcctcaaccgcgacgagaccctctgggccagctgggtgctgaagggcccgacccgccgcgccttctactccggcgacaccggctatttccccggcttcgccgagatcggcgccgaacacggcccgttcgacgtcaccctcgtgcaggtcggcgcctacggcgacgcctggcccgacatccacatgttcccggaggacggcgtcgccgtccacgccgacgttcgcggcggcctgatgatcccggtccactgggccaccttcaatctcgctctccacgactggtccgaacccgccgaccgcacctgggccgaagccaaggcccgcggcgtcaaactggccatcccccgccccggcgaacgcgtcgacgtcgacaacccgcccccggtcgacggctggtggcagcagatcgcctgaccagcgcggctcaccgcccgctgccggctcgctgtcgacggtcggtcgttcgcggctggccggcggtcggcactccggtcgcggtgtgccccgcctgcgcggtccgcgccggggcgcggtgcgggaaattcacgatcaagttcctgatgtcgtgcgctgcggccgataaccgatcgccgctcccgccgagggcgcctccgggctgagctggccgctacgcgtccagagcgctcagccctccagcgctacatccgcgggtgcccggggaaaccctccgatccaccaagctgccccggagccgatctggccggcagcacggcgcgaccgataccggccttcccggacgctgccatgacggagtggatcccgcccaaccttgccgttacgcccgggatgttcaggaatccaagggccgatgccggcgtcggaggtgtgccgagtggcgggtggtggtcaggcgaaggtctcggggagggggatgccgaagcgggcgcagaggagggggacgtcgtggcggtcggcggctcggggtggatagccggtgtgccaggtgacggcccagacgggggcttcgcagcggactgggcggccgatgatctcgccgcggccggagagggcggcggcggggaagggttcgccggtcagggcggagccgtagtgcagccggccgtccgggcgggtctcgtacaggtgcaggtcgattttgcggcggtcgccgtcgtggagaacgaagttccaggggcggtcgccgggggtggggaacagacggtcgacgcccagggcggcgaaggcgcggaacgcccactccaggtgggtggccggcaaccacaggtcgatgtcggaatgctcgcgggtctgttcgccgagcagggcgtcgacagcccacccaccgccgaggcaggcctgcacccggtgcacgtccagcgcgtcgaacagcgcgacgacgtccgcggccgtggagacgtgtcgaccggccatcgtccctcccaccactcctgtgtccgctttgcgcatcgacgttttcgcgcaggaagggtaaccgcccgccttatcgtccggaacatcccccgttcggcccacgcctgcgggcccggttcccgacggaccgtccgccccgaaggatcgcggggagcaggcagcgcggtggatcgcggcgcacggtggtgtcggcgcggccgggggtgggctgcgggcggggaagaacgggagggcgcgggtggacagcccggaacggtggcgggctcgtcgcagctgggcgatccggatgtcgcgcgttcagcggtgcggcggcgggcgatcgggtacggatcgtcccacgtctcgcgcggccacgcggcggcgatcgccgccgggacctcggtccatcgcggcccggtggcgacgtggtcccgcaggccggccacaacggtgcggcgtggcggggcgcgaggcgaatgcggggggctgaccgcgtacgcggcaatcggggttgagggttttcagaagaggccgagggcggcggcggtcaggccggcgagcaggacgagcgcgccggcggctaatcgggcggtgtgtgcccaggcggtgcggcggtcctggcgcagcgagcggcgggtggagcgggcgtcctgccaggcggcgtgggtgcggccggcgcggtaggcgaggaacgggacggctacggcggccagcagggcgccgagcaggcgagtgatcatgatgggctcccggagtggcggtgggtgaaccgccagtctggggcgcgtcggccgccgcaatccagaggattctcgggcaaatagtggcgaaaaggcggcggccgacgacgaaccacactgtcagttatcggtcacagccggtacgcagacctggaccgcggccgggacgatcgaggcggagaaccgcttggtgcgggagcgggcgccgccgtcgagctcgtattcgagcttcgactccagcttgacgtcgatcttgcgggcccgggtggtgcggacgaacggagagctgtccgaccgcttcaccgccatcgtgccgagggcgcgggcccattgcagggcgccctgggcggtggcgacgccgacgtccagccagccgtcggtgggggaggcgtcgtcgaaggcgtggataccgccggtgatcgtgccgacgttgccgatcaggacgcagctggccgtgtcgtcgaaccaggcggtgccgtcgatcttgatggtggtgcgcggggcgtcgccgtcgacgtggcggatgccggtccagacgtacgccagtttgccgaaccggtccttcagggcaccgtcggcgtccttgatcatcgcgccgtcgaagccgacgccggccatcaccgcgaagtgctcgccgtcgaccttgccgaggtcgagacgcttgcggtcgccctcgaaggcgatctccacggcgcgttccatgtcggtcgggatgccgaggttgccggccagcaggttgccggtgccggccggcatgatcgcgaccggggtgtccgagccggcgaccacgtccagggtgcgctgcaccatcccgtcaccgccccagacgaccagcaggtccggtttctcccggagcgccttgcggacctgcttcggggctttgcggctcttcgggacctcgtaccacagcagtttcttgatgtcgtggtcggtgagacggcggcgtagctcgtccagcccgccgcccagggtcttgttctgatgggcaacgacggcgatcgtgcggggggttcgcatgtcgccgccgttacccgaaccggagctcttccattcaccggccgcagcggtatgcccgcccgccgtgatccactaaccggtttcagaagcgcgcgaacgaccgcaccggcatccgcggcccgtaccgcggggccatcaatccgcccagggcgagcaggtcgcagacccgcccccggtggccgcggaacggctcgagcagctccagcatccgctcgtcggtgccgcgcggctcgccggccagcgcgtacgccaccgtgttggggatgtggtagtcgccgacgctgaccgcgtccgggtcgccgaacaccgtgcggaccacctcggcggccgtccacgggccgatctgcgggagcgccgtcattcgccgggtggcctcggccggatcggcgcaccgctccagccgctcggcgaccgcggcggcgcgcagcagggcctgggtgcggcgctgctcgacgccgtgccggtggaactcccagtacgccgtgccggcgatcatcgcgggatcgggcggcagcaccagcccggccgggccgggcgcgggctcaccgaaatgccggcagatcgcccggtacgaccgatgggcctcggtgccggtgaccttctgctccaggatggcgcgcagcagccgggggaagatctgcccggtggccggcatccgcaccccggtgaacgtgccggccagtttcgccaccaccggatgccgccgggccagctcgggaaagccggtgacgtcgtcgcgcaggccggcgacggcgtcggcgcggtcgagcacccactcggcgcccggcccgtacccggtggccagcagctcaccggccgccctggtcaggcagagggtcgcggcaccggccgggccgcggaaggcgagccagaacgcgccgtcgcggatcgcgccgcacggatcgtgtttcggcaccagcagcgggcgcaccgacgcgccgaactgataccgctcgggcggtgtcaggcgccgggtcagcgcagaggtcacctcgaaactgtgccacagaaaagccgatggccctgtccccggtgcgggggtcagggccatcggacggtgatcgaacacccgagaaggctcgatcacccgggtgcggagcaatgccccgggtggaggccgggcagtcgcatgtcacgtccggcagggggaaggacggccggcgggcccgaaggggggtccggcggtacgcggtgggaacgcgcgcctccggttcggacccgccggagcgactgtgctccgcgagctactgcacgggtcagcggacccggacgcggaccacgtcgaaggcgggggtctggttggcacgctccatcatcgggatccggtgcgagccgtcaccggcccacgaggcgcactgcgcggtgccgcccgtcggcaggcccgggacctggatggtcaccgtgtccggggtgcggccgcccttgctgtcctcggtggcgacgaagaacgccggcaccgggtccggcgcgggcgcctcgttggtgttggcgagcatccggcaggcggtgtggaagtggccgcggacgatgccgttctgcagcacgctggactcgacgtagtaaccgccctggccggcggccaggaagcggtcgcggatcaggttgcgggtgctgaccttgagggtgaaggcggtgttccggttgaccacgcggggcgcctgggtgatcagcagcgacgggttgttggccgccgagccgacctcaccgaactcggtgctgacgcagcggtcgcccttctggaagccgtcgtgggcgggcaggttgctggtcgcgcagctgttggtgaggatgccgaggccggcaccgggcggcggggtggtggcaccgttgttgccaccgttgttctggccaccgttgttctgggcgccgccgttgttgttgttctgaccgccgttgttgttctgggcgccgccgttgttgttgttctgaccgccgttgttgttctggccgccgccgccgttgttgttctggccgccgccgttgttgttgttctggccgccggcgttggtggccggcgcgctggccgcctggctcgccggcgcgccggcgccgttgttctggccgccgccggtgttctgaccgccggtgttctgaccgccggtgttctgaccgccggtgttctgaccggcgccgttgttgttgttcccgcggcgccggttgttctggttgttgccgacgttcttcatcacccagtcgcggcaccgggcccgcacctgcgccgtcgtcgccacatcggccgacccgtcgtccggatgctgggtgaccgtgccgttgtcggtggtgtacgtgtcgcggcgggtgttggtcgacaacttggtctgcccacccgccttgaggttgtcgcaggcggcgagcgcggacttggtgttggggttggtgctggcgctcgagatctgcgtaaccgtcacgatgccgccgaacgccgccagcgtggccgccacggcgatgatccggcggcgtccgctgaaccatgtgggtccagtggcgcgccggtactttgaccttcgcatgggtgacaccttttctctctcgggggctaccgcgaacggaagatgcgcatcgtggtgatcacgccgaccaccagcgcggcagccaggacgagcaggactacggtgttgctgagacccggtactccaccaccgttgccggcggcggcgatcatctggttgtcgatcggcaccgggcccttctgcccgggagcgaccggggcggccgcggtgggcagcgcaccgtagtcgacgatgccgctgctctccagcagggtcatgtgcgtcatgacgaactggttggcctgctgggcgagcttgcggacgctgtcgttgcgggtcgacgcgcggatcgtggcgatcgccggaaagatcttgccgtgcgcggcgcgcagccggtcgacgtagatctggttgaactggccgcccgaggcgttgcgcatctcggcgagccagccctgctggtcgccgttgggctggttgggcaggtcgatgccgagcttcttggcgacggcccggtccagctcgtccaggacgacgtgctgcgccgagatcgacttgccgatcttgacgatgttcgggtcgtccgacttctcctgggccatgttgccggccgggatctcccagaggccggccagccgcaccttgatcacgaagtctttgtccgcggcactgaccgtgcctttcgcggtgtcggtgagcccggtgttcggcggcaccggaactccgtcgtcggcgtgcgcggccccggccggcgtcagcatgaacgccagcaccacggtcgttgcacccaccaaccaggacttcatcctcgtacccatcgctttcagtagctgtagtcgccggcggaatcgctgccggagggcggcgccaccggcttcgagatcttggggaggcaggtgaggttcttggtaccggtcggcgtgaccacgaaccacttgccgttgacgttctggcccttccactgccccggcttcttgtccccgacgtagtggtagagcggccaaccggcgagggtcagctgcttggtgccgtccgcccgggtgaccgtgccgaccagtttggcgtcgacgtccttgagggtcggcttgccgtcgttggtcagcgccggcggccacaccttggcgcagtcgccgttgcagttggacttggccgggtcgtggccgtcgtcgtcgaagcggtacagaacgaaaccgttctggttctccacgacctgacccatccgggcgaccgaggtgccggtgagcgacttggtcacctgcttgtcggcgaccggcttgccggcggcgccggcgccggagtctagctagctaggtcccggcgacgttcgggtcgaccgcaccggcggtcgacgcggcgcccggggtcgcggccacgtcggccgcggcgggctgggccgcgttgccgtagtcggccgcgttgtagccggccggagcgcaaccgggcagtgccacgagtgccgccagcgccacgccggtgaccatcaacttccgcttctccggtaccactgggcttcctccagctgatcgacaacccgtagccttttccgcgctgtagtacgcgaccggcgcggcagcggttgaatattcgggtcgatcaaattcgggaatttttgcttgaaccatccgggcgtcgcgcacgtaaaaaagggcccggccgatgcggccgggcccttcgtgtcgagacgattacagaatgctcaccagagtctcggaaccgccaccgggggtcagttcctgcacctgcacgtgggcgatgtcgtcgcgcggggtgccggtgaccgcctgcagcatcagcggggccgggttggcggcggtgccccagcccttggcgccgatcgtccaggtggccacccgctccgaggtgccgtcgcggtgcacgatggtcagtgcgcacgtcttcgggcccttgaggttgctgaccgcgaaggagatctgcgtgccccagtccttggtctccaggccgaccgccccccgcacgttggtgcgcgagtctgcactgctgtggttctcgcccggcagtgcggtgccgccgatgccgaggccgttgctgtccggcagcgggtcgagctggtcgctgccgcgctgcgcggtggtcgccgggttcttcgacgtgtccgagccgagccacttgccgccggcgaagagtgcgccgatggagagcatggcgaagatgaccacggcggcggccagcgagtagagccgccggctgttggcccgctgccggtccgaccggacctcgcggatcatcttgttcagcagcaggccgtcctgctccgacttctcggcggccagcagggcctccgcgtccacatcggccagcacgtcggccacctggacgaaggactccagctcgagggcgcactgcgggcactcgatcaggtggtcctcgaaccgggcggcgtcgcgctcgtcgagcacgcccagggcgtatgacgcgacgtcgtagtggtcttcctgtgtcattccgtcaccccccgctgctgcagagcggtacgcagcgcacgcagagcgtaatacacgcgggacttcgccgtacccagcggaaggttgagcgcctcggccgcctcgggcacggtccgcccccggaagtaggtctcgatcaggatctcccggtgggagttgctcagctgccggagggcatccgacacggtcatcgactgcagcacgcggtcggtgtcgtccgcggtgctcgggaagctctccagctcgcggtcgtacgtctccgcggggcgcgcgttcgcgctgcggtgctcgtcgatcgcgatccggcgggccaccgtgaccagccacggccgcagggactgctggccctgcgcaccgagccggtgcgcgttgcgccaggcccgcagcagggtctcctgcacgatgtcctcggcgcgctgccggtcaccgccggtcagccgcagcacgaacatcagcagcggtcccgcgtgctcctcgtacagcagcttgaccagcgtgtcctcgtggctggggccgctggccggcgcctcgtggcgggccgtctggcgggggatcaccgaaccgtcatcctgtgcaccacggcctccgtcaatcgcctgccacctgctcccggagtgtcgcgccatcacacgcaccctctccggcgtgagccgatcctcggccaccgcatgcatcgatacctccgcccggacccttccccgtcgcctgagatacggctggggggcccggccgggatcaaagccggcgcgagattttccgggacactcggtctcaagggtcctccgcaagtggtgacgaacatgatggcgcaccggggcgcaggtcatgggggattgatccacgccgattcacgacgccggtaaggcggaatgatactcagtcacatcggagccgagacatggctctggaaataatttcgcccggccgggagatggcgatttcgctgtgtgaacgcgcgattccgctgggtgcgcggagatgacttatgtgtggcgaaaggcgaggtcgccgaaccgttcgggggatgtccggatatccgatggaccctttcgggcgacacccgtccgggagcgctcccagttcttgatcttgcagctccgacgcattcgggtttggtaagcgactgtttaccagcggcgccggagggcgcgccggaggtggtgatcaccgaggtccgggtcggatgccggagcaccccgatcacattctttcgctcgcaactttcgtaccagtatctggacgggagtcctaatcagcgggaggctgcggtggccagcgccagagcccggtggagtacccgcgagtcacccagcatgccgcgcaggcggcgctccagcccggcgatcggcaccaggttctgcggggcccggggatccttgtacgacgaggaggcgaacctcggcagcgtcgccccggacagcccggccagttcgatcgcctgatcgacggtcagctcgggggaacactccacccggacgatccccgaccacggcgcgccggtggccccgggcagccgcagataccaggaccagccgccccacagcgagcccaggtggaagaccggggtgcgctggcccggacgcagcgcggtcaccaccgcggtgagggcggtcggcagatactgcttctgctgggtcttgatgtagccgatggtgcgcggcagctgacgccggttgcgcagcgggccgtcgacgatcagcaggtcggcgccgtccgatccggtgtcccgggcggcgctggagatctcgatctccagcgcggtgagcggcccctggaccgcggccggcagcttgctcgcctcaccggtcccgttgatccggtggatctcgtagcggaccgtgccggcctgcagatcggcgatcgacgggctcgcggtgaacaacccccgccccacccgcgccgccaccagctcggccaccccgcggcccagatcgcagcgcaccacgccggccgcgaaggaggcggccagcccggcgtacgaggtgccgtcctcctccgccgtccagatctgcgcgtcgttgcggcgcacgccgtcgaccaggaacaccacccgcggtgcccgggccccggccggcacgtcgatcggcgcccacgcggcggccggcacctcgacgtcgacctccacctgcgcgctgctgggcgaggccggcccctcgccgtccccgccctcgaaactcgccccgtacgccgggtcccacgcgtcgacgaacatccgtgtcacaggccgaccctctcgacgtgcgcggtccgcgcgtccttgtggacctcgaaccggaccggcacccgctcggccagcgcctgcacgtgggtgaccagcccgaccatccggtcgccgcgggcggccagattttccagcgtggccgccaccacgtcgagcgtggcggcgtccagcgtgccgaaaccctcgtccagcacgatcgactccaggctggccgcggtggtgctcatcccggccagttgctcggacagggccagcgccagggccagcgacgcctggaacgtctccccgccggagagcgtgcgcacaccccggcgcaacccggcgtcgtggtggtcgatcaccgagaactcgcccttgtcgtgcatcaattcgtactgcccgccggtgagctcgcgcaggatccgcgaggcgccgtcgaccagcaggtccagcgcctcctccagcagccagcgctcgaagttgttggcccgcaggtgaccggcgagcgacttggccacccggctctcccgctgcagcgtcatccgccgctcctgctgctcgcgagcctgcttgtgccgctccaccagacgctgccaggcggcctcggcccgctcggcggcgaccgcggccgcccggatcagggtggcctcggcgtcctccggggcggtcgccggcggccgcaccccggcggcggtgaacagcgcggcgatcgcgtcctgcgcggcggccgtggatccgtgcgcggacagcaccgcggtctcggccgcggcccggcgctccgcccgggcggctagctagctagagatgcccgcgcagcgcgaccgcccggtcccgctgctgggcgtcccggtagtcctgccgggcctgctccagcagctgctgcgcgccggtgtgctcggactcggcgaggtcggccgcggcgcgcgcgtcccggcactccatctcggccaccgacaccttgccggcgaaccagccctcctgctcgaccaggcgggacagctcggtgtgccggtccagcgccaggcgcagcgaacccgggtcgccggccgcggccagctcgccgcggaccttctcctcggcctcctcggcctcgtgcaccgcctgcgccgcccgggcggcggcgtcgcgggccgcggtgacggcgccggtcgcctcgtccagattgtccggagtacgcaccgaggcgagcagtgccagctcggcgtccagcgtgtcccgggcgtcgcgggcggccgactcggccgcccgggcctcgcgcagccccggcatcgcggcctcgaccgcgccggtcagctcccgcatccgggccaggtgcccggccgccgcctcgaccgcctcgtcggtggcgtcctggagggcggccagcgactggtcgaccatggtcagcttggtctcggcggtcttgccccgctcggccgccttctcctggacccgctcgtacatctgcaggccgagcaggttgatcaggatctgttgccggaccgccggcttggcgtgcaggaagtcggcgaactggccctgcggcagcaccacgcagctggtgaactgctcgtagggcaaaccgaccgcgtgcagcaccgcgtcgtccatctcggccgggacgccggccagcacctcgcccaggtcggtcaggtccatgccggtgtccagcttggtcacgtcgaagccgggcggcatcagctgcaggccggcgccggacgtcttgacgttgccccggccgtcgcggcgcaccacccgggtcgccacgtagcggtcaccggccgactcgaagaccagccggacccgcgcctcggccgcggacggggcgagcgcgttgccgatcccgcgggcgccaccccagcgcggcacctggccgtacagcacgaagcagatcgcgtccagcacggtcgacttgcccgagccggtcgggccgaccagcgcgaagtagtcggcgtcggtgaagtccacggtggtctggtcgcggaacaccgtgaaaccggacatgtccagccgaaggggcctcattggttgctgctcacctcgtcgtacagctggtcgaagagctcgcggacaccctcctcggcgttgccgcgactgtccaggtagtcgccgaacagctcacgcggcgaccggccggcgcgctcggcggcccgggccccggtgcgctccggcagcatgtccgggtcgatccgtacctccaacgcgttcggcagcagctcctgcacgtcctcgcgcaggccggggcggggcgcctcgcgcaccaggacacgcagccaggcctccggaaggttcaccgtggccagctgttcgagggtgccgcgcaccgtgcgcagggtgatcgccgaggtcaccggcacgtcgcggacctgggccgccctgtccacgccgacgtcgacgaccgccaccgagcagacgttctcctcctcgccgaagtcgatggcgagcgggctgccgcagtagcgcaccgggcacgggccgatcacccgctgcgcgcggtgcaggtgaccgagcgcgacgtagtgcgtgttctgcgggaagacggtggagggcacggcgtaccccatgatggtgtgcgcctcgcgctcaccgccgccggtgctcgccccgaccagggtcaggtgcgaggtgatcaggttgaccacgccgggctcgccgaacggctcggcgagcttggcgatcaggcgcgcgatcagatcggcgtacgtctgattggcctccgcctcggtcaactcgtacatctcggcggcgcggatcgcgtaccgctgggacaggaacggcaacgccaccagccgccaccgctcgccgcccgcggtggtgccctcgatcagcaggtcgcccaggctgtcccggaccgagccgcgcagctcgatgccggccgcgtcggcccacgggcgcagtgcgtccagcgcctgcccgttgtcgtggttgccgccgatcgccaccacccgggcgccggtctgccgcagcgcggacagcgcgcgggtgaccagccgggtggcgtccgcggtcggcgccgcggtgtcgtagaggtcgccggcgacgatcaccaggtcgggtttctccgcccgggcgatctccaccacctgggcgagcacccggatgtgctcgtcgtgccggttgcggcccttgagaaccttgccgacgtgccagtcggaggtgtgcaggatgcgcatcgcgaaaccttagccccaggtcctagaacgggatgtcgtcgtcaccgccggcccggccgccgatcacggcgaacgggtcggcggactgcacgatcgagcgcagcgtctcggccggtggcggacccgactccgacttgcgggtggcccacgccgggaacgggaactcgacacagagcgggaccgggatgtccggctggttgacgaacatcgtgccgggccgggccagcagcgcgcgctgacgcatcgccgggggcaggaagccgtactccggacgggacgcctcggccgggtcgagccggccgaccacccggatcgccgagttcgtgacgatccgccgctcgacctcgctggcggtctgctgcgcgccgatcaggatcacgcccagcgaccggccgcgctcggcgatgtcgagcagcacctccttgatcggcgaggagccctcccgcggggcgtacttgttcagctcgtcgaggaccacgaagagcagcgggcggccggtgccggccttctccttctcctcgaactcgctcttgagcgtgacgccgaccacgaagcgctgcgcgcggtccggcaggttgtgcaggtcgacgacggtgacctgggcgctgtccgcggtcttgatctggtgcgggcggcgctgcgccaggtcgccgcggatcagccgggccagatcacgcttgctgccgatcaggcggcgggcgaacgcgttgaccgtgcccatgctgaccgcgctgccggcccaggtggagcgggtctcgtcgtcggtgagctgctcgacgatgtggtcgaccagatcgccgtacgagccgatccggcggccgtcgatgctgatcccgccctcggccgggacggcgaaacggtgcaggtgggcggtgaccgagtggaccaccatggtgtattgctggcgctcgtcgtcggcgtcggcgaacacgtacggcaacagcttggtggaacagaactcgtcgagcgtccagtagaacgcgtcgacgccggtcagccggccgctcacgtcgggggcgccggacgggtcgccgggccgcggcggggcgtagacccgcacgtcggtgaacgggctgtcgggcaggtcgagcagcttgtagtaggcccgggtggggtcgtccagcttcgtgttcgggtggtcgaggaagagcagatcctcgcccttcacgttgaagatcagtgcccgggcgttcgccccgtcggcgccgagctggccggagcggaacaccgagtagagcaggaaggtggcgaaactcgtcttggtggcgacgccggagatgccggagatcgacacgtgcgcgccgcgggtgccgtccaggaagtccgcgttcaggaagaccgggacgccgtcgcggccggtgcccatcgggacccggcgctccatccggtcgaagtgcagggcggcgtcgcggtcctcgccggaggcgcggtgcacgatcgcgcccggggccggcggaacgtagagctccgggtcgacccgggtggtggtgatctcggccgcctcctggaccatcgcgggcagggtgccgtcggcgatggcgaacacgtccgagtcgaactgggcgccctcgtgccgggcgcggacctgggtgaccacgccggagatggtcaccggctcgcggtcgggcagatcacgcctggtggtcacgacgtcgtcgagctgcaggtagctgccgggggcgacggccgtccagaactggagcggggtcgcgtcggcggtgccgagcacccgcccgacgggggaagtttcgtcagacacggggatcatgttgcctcagcggtatgacaaaacgctcgggctaccaccggtggggtccatccacagagttatgcacaagatcttgatcagctgtggacgacacgcgtgtagcggaggaagagcatgtcctcccgggtcagcgcgtgccgcagtgacatcggccgcggcggcgtcggcggaccgctcgcgatccggccggccgagccgccggccagcagcggcgccaccgtgagacacagctcgtcgaccaggtcggcggcgatcatcgagccgagcaggcccggcccgccctcgcagagcagctgggtggcgccgcgccggtgcagctcggccaccccggcggccaggtcgacccggtcgtcgcccagctccagcacctcggccaccgcccggatcggggaatccggcgcgccccggtgggtgatcacgatcgggcggatcggcgcgtccgagaagatcaattgctccggatccaggtcgagcgaaccggagacgatcaccatgagcgggaactcgggcagcccgtgcgccacccgccaggcccggtcctcggcggtcaggcgcagcgcgtcgtaccgctcggcgcgtaccgtgccggccgccacgatcagcgcgtccccgagcatccgcagggtgtcgaatacctccttgtcgcccgggccctgcaacccggcggagaggccgtccacgctgaccgcgccgtccgcgctggcgatgaaattcacccggagggtgggccggtcggcgcgcggatagcgctcgaccaacccgtcccgggtgtccgggagggcgctcactcgccgggtgggccggtcaccggcggggtcggctcggccggccggtgctggcagtcgcaccacgagccacccttgcagtcgacatgccgccgttcccggcaagcctcgcaaatcattccccgactctagtgggcgggagtgtccgacaccggacatggacgggtgaagccggagccgcgcctgcccgcggtgagttgtgagatccggcatcaccgaccggcttgacggcggggacacggccgtgcaaccggtcggaaacgcggagtcggcagggtggtcaggggacggcggcaccgggccgtccgcgacgggaggagtcacatgttgctgcgggttcgagtcaccctgccggaccgtcccggcgccctcggtcaggtcgcgcgcaccctcggcgtggccggcgcggacatcgtccaggtggtggtgctggaacgtctcggcgggcgggcggtcgacgacttcaccgtggtctggccgggtgcggcccgggtcgaccggctgttggccgggctcgccgcgatccccggggtgcaggtcgacggggtgtggaaggccatcggcgcgccggtcaacgggggccacgacgccgaactgctcgcccaggtggcggcgaacccggcggacggcctggccaccctggtcgacgcgatgcccgggctgctggcggcggactgggcggcggccgcggtggtcccggccgactgggccagccgcaacggcgggcccgggacgggacacgagccacaggtgacgtacgcgagttggcgggccccgtcgccgctgcgcctgcccgaggtgaccccgctgcgggcccggccgttgaccgagccgggcggcgcgcggtacgcggtggcgccgttcggccgggccgggctggtcctggtgctggcccgcaccgacgaggcggagctgccggccgcggcgttccacgtgaccgaggtggaccgggtggcgcagctggtccgggcggccgcggtgatcctcggcgaccggctcgacacggtgaccgccgccaccgtccgggtgtgacgatcacaacccgcgaaatagcagctcaggcaatacgacggcaacaacgccggggcactcttgaggcagagcgaaaggagtgccccgcatggcgttgtggcggatccgggccacggtcgacgaccgccccggctatctctccgtgctgaccgcgagcctcgccctgaaatcggtcaacatcctcgccgtccaggtgcacaccaccgagggcggcgcggtcgacgacttcctggtcgacgcaccggacgcgatgaccgaggccgacctgctggccgcggtgaccaagggccgcgggcgggatgcgttcgtgacccgtgccgaggcgcagggcctggccgaccagcccacccgcgcgctcgcgatggccggccgcctggtgcacgagcccgactcgctcggcgagacgctggtggccctgctcgacgcgaccgacgtgcgctggcgtccgcacccggccttcgaccggcccggcgtgcacggcggtcggatgaccctggccgacccggccggcgggtcgtacgaggtgctccgcgcgctccccgcgttcacccccgcggagtacgcgcgggcccaggccctggtcgagctggccgccgcggtcacccgccaccagcgggagaacgtgaccttcctgctgcccgacggagccgaggtgaccctgcgcccggccaccgcggacgatctggccgccgtcgccgagctgcaccggcactgctcggccgcggccctgcggcggcgctatccggccggtccgcccaccgagtcccggctgcgccggctgctggagccggccggtgggctgactctgctcgcggtcaccacggccggccgggtggtgggcaccgccggcctgatcgtcgaggggcagctgggcgagatcaccgtgctggtcgaggacgcctggcagcgtcgtgggctgggcacggcgctgctgcgccggctgcgggcgcacgccgagcggtccgggctggccgcgctggtggcgcacaccggcgcggacgacgtggcgacgctgcgcaccctgcgccgcctcggccacggcgagctggcgcgtgacggggccctggccagcgtcaccctgccactggcgggtcagccggcgtccttggatactcccgccacctccgggtgacgggtcagaggggtggcggtgggtactgattcaggcccgccgccaccctcggggtcaccctcgccgggtgccgtgctccacgcaggtggccgtccagccggtcggcagcacctgcaccttcatccggcggcggcactccgggcagtaacggggcggctccagctcgcgggccgccgcgcaccccgtgtgatcgcccgtggcggtcgcctcgccacaccggtcgcagaacatctcagagggtcgccgacagggctttgatcggcatctgcagatcctggagcagctccaggtcggcggtggccgaacggcccagcgtggtcaggtaattcccgacgatcatcgcgttgatgccgccgagcaggccgtcccgggtgcccaggtcgcccagcgtcagctcccggccgccggcgaaccgcaggatcgtccgcggcatcgccagccggaacgcggcgatcgcccgcagcgcgtccttgccctcgaccaccggccggtcaccgaacggggtgcccgggcgaggggagaggaagttcatcgggacctcgtgcgggtccagctcggcgagctgggcggcgaactcggcgcgctgctcgatcgtctcgcccatgcccaggatgccgccgcagcagacctccatgccggactcgcggaccatctgcagggtggaccagcgctcctcccacgaatgggtggtcaccacgttcgggaagaacgaccggcaggtctcgagattgtgattgtatcgatgcacgcccatgtcgaccaggtcgtcgacctgctcctgggagagcatgcccaggctggcggcgacctggatgtcgaccgcctcccggatcgccttgacgccctgccgcatctggtccatcagccgctggtcgggaccgcgcaccgcggccacgatgcagaactcggtggcgcccgtcgcggcggtctgcttggccgcctcgaccagggacgggatgtccagccaggcggcccgcaccggcgacgcgaacaggccggactgcgagcagaaatggcagtcctccgggcagccgccggtcttcagcgagacgatgccctcgacctcgacctccgggccgcaccacttcatccgcacatcatgagcgagctgcaggagctcgggcaggtcgtcgtcgggcagtcgcaggatctcgaggatcccggcctgatcgaggccggcgccgccgtcgagaacccgggcacgtgcccggtcgaggatctgaggcatgtccgtaccctacagactctccggcgcggtaagaacggtcggacgtgggtggtagtttccggttctcgtgatctccggggccgatcccgtcgatcaccggaggccccgtgatctcccgggggcctcatgcttgtctggaggcgttgtggctgactggtccgagtcgctcgatcgcctggcccgcgaccgggccaaggcggggctcacccgtcacctgcggccacgtccggccgacgacgacgtcgtcgacctggccggaaacgattatctcggcctttcccggcacgtcgcggtgacctcggcggcgcggtccgcgattgcggcgtacggggtgggcgccaccggatcgcgcctggtccgcggcagcaccgacgcgcacaccgcgctggaatccgggctggccggctggctgggcgccgaggccgcgctggtcttctcctccggctacctggccaacctggccgtcgtccgggccgccgcggcggtctgcgacctggtcgtctccgacgcgtacaaccacgcctcgctgatcgacggctgcaagatctccggccggccggtggtggtcgccccgcacaacgacccggccgccgtcgccgccatcctcgacgcccacccgggccgcaccgccgcggtcgtcaccgagtcggtcttctccgtcgacggcgacctcgccccgctcgccgccctgcacgcggtcaccacggcccgcggcgccctgctgatcgtcgacgacgcgcacgcgctcggcctgctcggcccggccggcgccggcggcgtcgtggcggccggcctcgccgggcagcccgacgtgatcgtcaccgccaccctgtccaagtcgctgggcggcgccggcggcgtggtcgccggccccgcacgggtcatccgccacctgatcgacaccggccgcaccttcatctacgacaccgccccgccgcccgccgtggtggccggcgtccacgccgcgatcgacctggcccgggccgccgacgaccgctagctagctagggtgtcctgtcggtcgtcgcccccggcccggaagccgccctcacctggtccgacgactgccgcgaccggggcgtcgcggtcggctgcttccgtccgccgtccaccccggacggcacctcgcgcctgcgcctgaccctcaacgcgggcatccccgaggcggacttcacccgggccctggacgtgatcctggagtgcgcaccgtgaacacctcgtcgtaccccgggatcgcggtcacccccctgccccgcggctggcgtagcggcggccacggcctccccgccccggcgccggcccgccggccggaaggccgggcgttgctgccggcgcacggcagcggccacgacatgacgacacccgcccgacgggacgggcccgctccgttgcctgttcgcggtggtggtcacggtttgccggcttccgctccgttgcctgttcgcggtggtggtcacggtttgccggcttccgctccgctgactgctcacggcagtggtcgggatatgccggcagcggctgcgcgtccggatgggccggcgccgttgcctgtctacggcagcgggcaccggctaccgcccggcggggggtcgcctgatgatggcggcggtcgccgtcaggtgccggccgccgctctgcccgctcggggtggtggtcaccgcctgcggcccgcggttccgccgcccgcgcagggcggtggctcaccgtcctcgcccgttgccgctccgggcggctcggacacgtcggccgcggcggagcctcggtcgagggacaccgggggctcgaagtcgtcggcgggatcgccgggtgcgggggaatccgggccagggggcgtgggcgatgcggagtcgctgacggggccttccggtgcggggaaacctcggccggggagcgcggatgcttcggagccggtggcgggacctccgggtgcgggggcacctcggccggggagtgcggatggtgcggagccggtggcgggatcttcgggtgtggcggggtcgcactccccgtgcgctggcgggcacggtgtgggggacgacgggcgggctgacggcgtaccgtcgcaggatgtgaccgcgccgcccgttgaacctggaagcgacgagacggccgcagccgtcaccgacctggaggatccgccgcgggcggagctcgacaagggagccgcggtcgcgaacccacccggatcctcgggtgatgaatcggaaatgtcggatcctggagaagcaggttcggtcggtcggcgaccggcggaagcagccggggcgacgggagacgcggaatcagcggcgggctcggtgggcggcgcggcggggacttcggaagcagcggcgggctcggagggcgacgcggcgggggagccggacgtcaaggcggcggctcggcgggcggccacggccggtgagtggcacgggatcgtgctggtcaccgggaccgacaccgaggtggggaagacgatcaccacggcggcggtggccgcggcggcgcaggcggccgggcttcgggtggccgtggtgaagccggggcagaccgggacgatcaccggggagccgaccgatgcggagacggtgacccggctggccgggccggacacggtgaagatgctggccgagtatccggagccgctcgcgccgctggccgcggccaaggtggccgatctgccgccgctggagctctacgaggtcgtggacgcgatccgggccgaggcggacaagcacgacctggtgctggtggagggcgccggggggctgctggtgccgatgggattgcggccgtccggggaggcctggaccttcgccgacctggcgaccacgctcggggcgaacgtgctggtggtggcgcgggcggggctgggcacgctgaaccatacggcgctgacgctggaggcgctggagcggcgcggcgtaccggcgaaggtgatcctcggtgcctggccggccgatcccgagctggtgcactgggcgaatctgagcgagctggtgccgcacctggtcggtgcattgccggccggcgccgggtcgatggatccgggggtgttccggcggtcggcgccgggctggctgactccggcgctgcacggggttctggataattggcgggtgtgggccgaggaagcgggctgatgcgggcggtcgccgcggccaccgcacgctgacgtcgagaggtccgaggatgacaagcgaagcgtcaccggggcgcagtgccgccgaccggagcgaggcaagccggcatcaggtgacgttcaccctgacgatcgactgtggtggcggcggcatcaagggttcggtgctggatgacgccgggacgatgcgggcgcatccgatccgggtgccgacgccgtatccgttgccgccggagctgttcgtcaagactctggtggatctgggtgggcagctgccgaccgcggaccgggtgacggtcgggatgccggggatgatccggcacggggtggtcgtggcgaccccgcactatgtgacgaggagcgggccccgcaccagggtcgaccccgacctgttcgaggcgtggcgcgggttcgatgcgcggaccgcgctggccgaggcgttcgggctgcccacgctggtgctcaacgacgccgaggtgcacggcgccggggtggtcgccgggaccgggtgtgagctggtgctgacgctgggcaccgggctgggctgcgcgctgttcgacgggggtgagctggccccgcatctggagatgtcgcaggcgccggtgcgctgggggatgtcgtacgacacgtacatcggggagcatgagcggcgccgcctcggcgacgccctctggtcgcgccgggtccgtaacgtgatcgacggtctgcggccggtcttcctgtgggaccgggtctatctgggcggcggcaactcgcggctgatcaccccggcacagctggcccggatgggcgacgacgtggtggtggtgccgaacacggcgggcatcgtcggcggcgtccgcgcgtggaccctgggccagcgatgatcgcagtggccggcgacggtcgggtggcgggtaaggggccggcggtgctcccggccgctctcctgctggatttcggcggggtgctggccgacgcgccggccgcccagcggtccgcctcgccggagctggtgctgcggatctacaacctgatcaacggggtgctgtcgcccggccagattcagcaggcgttcgcctccggtggccaggcctatgcccgctggcgcgacgaggatgcgccggacgagctgctccaggccgaggtctgggaacgtttcgtgatccgggactggcccccggccgcgcaggtgccggtccgcggggcgatcgcgagactgagctacgactgggcgttccgcccgggctgggcgttgcggccgggcatccgggaggcactcgacgcgtacaccgcggccggtgtcccgctggccgtggtcagcaacactctcagcggcgcggcgcaccgggacttcctggccgcggccggggtcggtgacctgttcgcggtgcaggtctacagcgacgaggccggggtccgcaaaccgaacccgcagatgatctggaatgccaccgacgtgctcggggtggatccgcgggcctgctggttcgtcggggacagccggcgccgggatgtggcctgcgcccgccgcgccgacgtggcccgggcgatcctgatgccgtccggccggcaggatccgccgggcagccccgagccggacgtggtcgtcgaggacggccacgaactggccgagttgatcagatggtgacctgccagaccgtggtggtgcggatcgtgcagctctccagcgcctcggtcaccggcacgtcataggtcgcccgcttcaccagcccggtcggcaggtaggcgcgcccggggtcgccgaccagcaccagcgatccccgtccggcggcccgccgcaggtagggcagcacccgcccggccatctcccggctgtagaagacgtcgccggccagcaccaccccgtaccgctcgtcgccgtccagcaggtcgccctcgttggtctcgatcaccactccgttgtcggcggcgttggcctcggccgcggccaacgacagcgggtcgatgtcgttggccaccacgggccgggccccggccttggcggccgcgaccgccaccagcccggatccggtggccaggtcgagcacgctgcgtccggcgaccaggccggggtcgtcgagcagatgccgggccagggcctgcccgccggcccaggcgaacgcccagaacgggggcggctgctcggtcccgccggcctcggtggcctcccagagcgcgatcggctcgtcggcctgccggagccggatctcggggacgaacgggaccggcgccggcacggtgtgggcgcgtacgaaatcgagtagcacccgacgattgtgccctttccctcagttccgtgatcccggagccgatcagtggagtcggaacgggtctcgggcgcagggaggtcggatgccgacgcggtggccggccgccctcttcggcgggtggatcctgctcctcggggtgggctacgccgcgcaaccggccctgcacggctggctggtgctggccggtggcctgtccgcgctgggcgccgtgctgttcggcacctaccgcagccagccggacgaccgggtgccgtggtggctgctggccaccgcgaccgggctgtccggggtgggtgccgcgctgggcgacgcgcccgagtccgtcaccgacgagctgctctggctggcgccggccggcaccgccctgctgctgctgtcctatccggcgctggccgtggcgctggccgggttcgtgcgccgccgcaccggggcgtcccgggacgttccggggctgctcgacgcggcgatcgtcacctccggggtggcgctgctggtctggacgttcgtgatcggcccgcggatgtcggacgcgtcggtccgggggctggagcagctgctgccggtcgccgacctgctctgcctggggctgctgatccggctggagacggtgccggggcggctggtcgcgtccgggtactggctgggtgccggcaccggggcgatgctgatcgcggacgtgttgcgggcgcccgcgtacggccagctcgcgctctacgcgacggccgggacggcggcgctgatcccgtcgatggcggagctcacccggcggtcggaggcgccaccggcggagaccagccggggccggctggcgttgctggcggtggccgcgctggccgcgccgagcgtgctgatggtgaagatgtcgcaggacggccaggtcgccgggctgttcctggtggcggtgctgagtctgctgatgctcatgctggtgctggcccggatgggcggcatcatgaccagtcaccggcaggcgatgggccgggagcaggcgctgcgtgaggcgtccgcggcgctggtgtcagccgccgacgcggaggcggtgggtctggcggtccggacgacggtggcccagctgctgcccggtgatgtgccgcacggcgtggtgctggcgatcagcatcgcgcagtcggagccgctgtcaccggaggccgccgcgcaggccgcggtggaccgggacaccggtaccgcggcccggctggtgcagaccagggatgtggactgggcggtggcggtgcggctcacccagttcgccgagacgctgcgctgcccgatggtgctgcaggatcggccgaccggtgatcccctggtcggggtgctgcacgtgggtgcgccgacgtgggcgttgcgggagctgcagcggtcggtggaggtgctggccgggcaggtggcgctggccctggagcggatcgcgctgagccatcaggtgaatcagcgcaacagcgaggcgtacttccggaccctgatcctgaacaccgccgacgtgatcaccattctggaccggcaggaccggatccggtacgcgagtccgtccgctctgggggtcttcggcgccgatccgaccgggtaccgcctgcccgacgtgatccaccccggtgaccagagccggctggaggaggccctggccgcggtccgtggcggggacaccgtgcagcagctggatttccgggcggtcggcgccgggcgcaccgaggtgctgctggagatgcactgccgggatctgagcgcggacccgagcgtggccggcctggtcgtcaccatgcgggacgtgaccgagcagcggcagctcgaacgggagctgatccaccaggcgttccacgacgcgatgaccggcctggcgaaccgggtgctgttccacgaccggctcaagcacgcgctggcccgcagcgcccgggacggctcggtggtcggggtgctcttcatcgacctggacgacttcaagatcgtcaacgacacgctcgggcacgcggtcggcgaccagttgctgatcgcggtcgccaaccggctggccggggcgttgcgggcggacgacaccgcggcccggctcggtggtgacgagttcgccgccctggtggagaacgtgaacgacccgggcgcggtcgaggagaccgcgacccggatcctgaccgcgctcgccccgtcgatcgacaccgacgccaagccgctgcacgcggtggccagcatcgggatcaccaccaccctggaggcgcaggacgccgacgagctgctgcgccaggccgacctggcgctgtacgtggcgaagggggccggcaagaaccagtggcggcgctaccagcggcatctgcacgacgagatggtggcgcggctggagctgcgctcggcgctcgaccacgcggtcaacgagggccacttcctgctgcactaccagccgatcgtcgacctggtcagcagtgccgcggtgggcttcgaggcgctggtccgctggcatcacccgagtcgcggggtgatcaccccggaccagttcatcgaggtggccgaggagagcgggctgatcgtgccgatgggccgctgggtgctggaggaggcgctgcgcacggtcgccgactggcgccgggtcctgccggccgggcgcaccccgtacgtcagtgtgaacgtctcggtccggcagttccgcgaggccgggttcgtcgaccaggtccgggcggcgctgcagcacaccggggtgccgcccgggtcgctgatgctggagatcaccgagactttgctgatgaaggacgacgaggcgcgggtctgggcggatctcggggtgctgcgcgacatgggcatccggatcgcgatcgacgacttcgggaccggctattcgtcgctgggctatctgcggcagcatccgatcgacgtcgtgaagatcgacaagacgttcatcgacgacatggtgaccagcccgcagctggtcggcgggatcgtcagcctggcccggtcgctgcagctcaccgtggtggccgaggggatcgaggacctcgaccaccgggatctgctggtgcggatgggctgcccgctcgggcagggcttcctgttctccagcccgctcggcccgaccgaggtgctggcctggatgaccagcctggccgtcgccgtctagtaggggttgccggtgcccggcaggcggccgcgcagcaggccgccgaggcgtcccggctggctcgcggccgggtccagcggcgggctctccggtcgcccggcccggtcggccagcccggccaccacctcgtgcagcgcgtccaccgcgccccggcgcggccgccagcccagctcgccggcggcccggtcgcaggacatcaggggcgccttgagggccagccgcacccagccgcggtcgaccggctgcagccgcaacgtccagctcagcgccgcggcgccctccagtgcgaacccgggcaccggcagcggcaccccgcggaacgccttggccagcaccatcggatcgagcaccggtccggccgcgatgttgaacgcgccgcgcacgtcggcgcgcagcgcccgcaggtaggcctcggcgacgtcgtcggcgtgcaccgcctgcagccgcagccccgggtgcgccgggatgaccggcacccagccggggcgcagcagccgggcgggcagcagcgggccggcgaaataccggccgatctcggtgccggcgtcgcgctggaagatcagcccgggccgcagccggacgacgcgcatcatcggatggtccgactcgatctcgtcgagcatccgctcggtcagcaccttgtggcggctgtacgacgactccagcaccccgttgcgcgcccagctctccttgacgtacgcccatttcggccccggcgagtacacccccaccgaggaggcgtgcaccagcgtgctgacgccgccgcggatcgccgcccggaacaccgcgcggctgcccagcacgttggtccggtacagctgccgggtgtcgtggctgggctggatctgccaggccaggttcaccaccgcgtcggcggtctcgaagatcgcggtgagccggtccagggcgtcgtcccggccgatgtcgaccgggtgccattccatcccggcgtaggggccggtgtcctgcgggacgcgccgggcgatcccgacggtttcgatgtcgggttcggtccggaggcggcgcagcagcgcggtgccggcgttgccggtcgcgcccacgatgacgacacgcatgtcgtgagccgtaccccggccacggacttcaaatcggtttccggcgactattcccggccggattcacgccgttgcccagaagacggtaccggcccgtcgtatcgatatcctcacccgcggattgactcaggtcatcggtggaacggccggcccggcggcggcgcgggagtccggccaacgcaaaacggcgccaccggtgacccggtgacgccgttttacgggctgcgcaatcagcgcttggcgtggtatgcctcgacgacgttgctcgggatccggccgcgctcggaaaccgggtaaccgttcttgttggcccactcgcgaatggcctggttctggtcacggctggaccggctggtcgcggccggggcggcgcgccgggcgaccggcggggtggcgccggaacggcccaggcgggtggccgccgagaggaacggttccagggccttgcgcagcttgccggcgttcttctcggacaggtcgatcgtgtagttgacaccgtcgagtccgaattcgacagtgcggtcggcctccccgccgtcgaggtcgtcggtcagaagggtaattatctgcttcgccatgtcgtgttcgctcctacagcgatgtcattcgggtgacggctgtacgcgagcgatggggggtgccgcgaatagtcgtcgtcccattcattgtgtatcccgcacggcaagcattgcaaattgcccctaggcatgtcgcaattccgctgcgcatccacccggcagcggagggtggtcttcgctggtcggaaagaccctgagaagactcttttcgaactggtgaatgtggggtaacctcaccgctgggagcgctcccaagggcggagccgtcccgtagactcgagccgcctcgtcgccgatgctccggtgccggggcggctcgccccaactattttccggcgcggcgcagcgcggccggagcatgtgccggcaccgcgggtgagtgtggtgccaccggctccaccggctcgtaggcttcgcccggcgccggccgcggatccgcctcgcccttgttcggccacagcgacatcgcccgctccgccatcgcggtgatcgtcagcgacgggttcaccccgaggttggccggcaccgccgaaccgtccaccacgtgcagcccggggtagtggaagacccggtggtacgggtcgatcacgccgctgtcggcgtccgcaccgatcgtcgccccgcccaggatgtgcgccgtcatcggaacgttgaagatgtcgccgaccgtgccaccggggaagccgtcgatccggtccgcgatccgccgcaccgcctcgtgccccaccgggatccaggtcgggttcgggtcgccgtgtcccgggctcgtcgtcaaccggccgcgccgggtgcgacgtaccgtcagggaattgtccagggtctgcatcacgagcgcgatgatcgtgcgctcgctccaccgccgcaccgacagggagtgggccagcaccatcgggtgccggatgcagttgaccaggaagcgcagcggtcgcggcagccgcccgccgccgtccaccagcagggtggacagcaggcccatggcgttgctgccgggcccgtaccggaccggttcgatgtgcgtggtcgcgtccgggtggaacgacgaggtgatcgcgacgcccctgctgaacggctcggccggcaccttcctggtctcggcgccgagcagcgcctcggagttggtgcgggtcagcgagccgatccgggcggagatccggggcagcaccccggtgtcgcgcatcgcgtgcagcaaccgctgcgtgccgagcgccccggcggccaggatcacctgcccggcggtgaaggtgccgttggccgtctccaccacccagccggcgccgtccggccggatcttggtgacctcggtgtccgggtggaccgtcgcgcccttgctctcggccaggtagaggtagttgacgtcgagccggttcttggcgccgacccggcagccgatcatgcagttgccacactcggtgcagccggtgcggtccggtccggccccgccgaagaacgggtcgggcacggtcttgccgggctcgccgaagaacaccccgaccggggtgcggcggaacgtgtgcccgacgcccatgtcctcggccacctgcttgatcaccacgtcggacggggtcatcgtcggctgggtggtcaccccgagcatccgggacgcctggtcgtagtgcggctccagctccttggcccagtcggtgatgccggaccagtgcgggtcggcgaagaacggcgcgggcggctggtacagcgtgttggcgtagaccagcgagcccccgccgaccccggccgcggacagcaccatgatgtccttgagcagggtgatccgctggatgccgcgcatcccgagcttcggcgcccagaggaagttcttcaggtcccatgacgtcttgggcagggtctcgggggtgaaacgccggccggcctcgaggacgccgacccggtatcccttctccgtcaggcgcagtgcgctgacgctgccgccgaagccgctgcccacgatcacgatgtcgtaatccgtcatcgtgtcacctaagcattactcgccggtaaccgccagagcctgtttctaccgccggtagatggtcatcgcgtagcccacctggtcgatcgctctgctcgtgtcgatcaggcgctggagcttcacgccggccagcgccacccgggagtcggagaccaccagcaggccgtgcacccggtcctccggaacgccgtacggatcggtggcattgatcccgtaataggcgggcacgccactgcccttgtagacgagccacaccggttcacccggatagtcggtcctcagcttctgcgccagccgggccaggtcctgaccccagtcgacgttcgagtcgtgcaggttgcggtgggtgtccgcggtgccgccgaacgcctcgttggagtacggcaggtaataggggaatgtgcgcactgagctgatcgcgacgaacaggatcaatgccgcggtcacccacggaacccggcggatccggatcagcgcgaccgtcccggccgccaccgcgaggaacatcggcaggaagatcgcgtaccgggtgccgtagtcgcggctgccggtcatcgccaccagcaacagcagcgccgaaaccggcagcacgtagaccgccgcggcccgcagccgcggcacgaggatcatcgtgagcgcgccggcgatccacagcacgagcatccccagtggcgtcttgatcagcagcgccaccggcaggtagtaccagaggttgccgcggtaggcctgcccgagcaggaacccgttgtaggtccgcgcctccagccggaactgcagcagcaacccgtcccgatacgcctgcggcagcggcagccactgcaccgcggccgcccgcagcccgtccggatgcgccagatagtccggggtcgtccagcgcagatgcggatcgacggccagatagaccacccagacgacggcgaccgcgatcaaccccacgccggcggcggccagggcgccggccaccagacgccgtcgccggctcgccgaccgctgggcacgccacatcgaccaaccacagagcagggcgatcagcggtacggcggggagcgcgctggcccgggtcgccagtgccgccccgagggccacgccggccagcggcaggtagcggtacgcgcgttcccgcccccgccacgccagccagaacgcggtcagcagcagaccggcggccggcacgtccagggtggccagcgacccgtgcgcgatcacatccgggtcgaacgagtacagcgccagcgcgatcagagcggcccacggccccgccacgtcccgcgcgaaggccagcaccaccagcccgaacagcagtgtcagcacgatgatcgggacccgggcggcgagcagcagccggaacgggttgttcccgctctcgtagagcaggttgcgtcccagcgcgctctggtcgcccggatacgccgggtccagccggtgcgcgccgccgaacgccagcccggtcgccatgatcagcttgccgagcggcgggtgctcgaagttgtagcgcaggctgtgctgctgggtgtacacctcggcggtggcgacgtacaccggctcgtcgatggtcggcgtcagctgcgtcgccgtggtcaccatggcgaacgccatctgccccagcatcgcgaccacggccagcaggaacaacagtcggcgacgaggcatcgggcaaagatagcccgccggccggacctacccggtgaactcccccggcggggtggcggccgggtcggcgtgcttggccacctcggcggcgcgcaactcgacccggcgaatcttcccggagatcgtcttcggcaggtcggcgaactccaggcggcggatccgggcgtacggcggcatgtgcttgcgggcgtgctcgaagatcgccgcggcggtcgtcccgtcggccgcccacccctcggcgagcagcacgtaagccttcggcaccgccagccgcaccgggtccggtgagggcaccacggcggcctccaccaccgcctcgtgctcgatcagcacgctctccagctcgaacggcgagatccggtagtcggacgccttgaacacgtcgtcggtccgccccacatacgtgatgtagccgtccgcgtcccgcgaggccacgtccccggtgtggtagtagccgtcgaccatccgctcgccggtcagcaccgggtcgccgtgatagcccaccatcagccccaccggccgcggctccatcgccacgcagatctcgccctcgtccgcctcccgtccggtgaccgggtcgagcagcgcgatccggaagcccggcaccggccgccccatcgacccggccttgaccgggcaccccggcgagttggcgatctgcacggacgtctcggtctgcccgaacccgtcccggatggtcaccccccacccggccttgacctgctcgatcacctcggggttgagcggctcgccggcgcccaccgcgatccgcggcggcgtcgtcaactcggtcaggtcggcctggatcagcatccgccagacggtcggcggcgcgcagaaactggtcaccccgcagcgctgcatctcggccatcagcttccgggcgtcgaaccgggtgtagttgtagatgaacacgcacgcctcggcgttccacggggcgaagacgttgctccaggcatgcttggcccagccgggcgacgagatgttgaggtgtacgtcgccggggcgcagcccgatccagtacatcgtcgacaggtggcccaccgggtacgacacgtgggtgtgctcgaccagcttgggctgcgcggtggtgcccgaggtgaaatagagcagcagcgtgtcgtcggcccgggtcaccgcgtccggcacgaactcgggggccgacgcgtacgccgaccggaaatcgcgccagccgtccgccgcgcccaccgcgatccgggtgaccgccggatccacctggtcgaacttggccaccgccgaggccatcgcgatcacgtgccgggcgccgccgcgggtcacccgggccaccgcgtcggccgggccgagcagcggggtggccgggatcagcaccgcgcccagcttcatcccggcgaggatggtctcccagagctccacctggttgccgagcatcaccacgatccggtcgccacgggccaccccctgggcacgcagccagttcgccacccggctggaccgttccgccatctcggcgaacgagaaccgctgctcggcgccgtcctcctggacgatccacagcgcgggcgcgtcgttgcccgcggcgatcacgtcgaaccagtccagcgcccagttgaagtgcgccgggcgcggccagcggaaaccgtcgtacgccgcctgaagatcctcgcgatgagcgagcaggaagtcccgggcctgccggaagtcggggtcagccatggggccatcctcccggttggaacagtggcccgctagaagcttgtcggaacgcgttcgcgggccgcggccagtcgggccggatggcccgcggcctgctgccagaagcggtacaccaggaccagctcgaaggccagcagggccgccccggccagcacggtgaccccgatgatcagcccggtcagcgggccgatgatgtagacgaacatctcgtactcgatgccgctgaacaggtgcgtccggatccggttgcggcgcagcagggcgccggcccggccacggcgggacagcggtggcgcgccggcctcggccggcacggccagcgcgcccagctcgtcgaccatcgtctggcgcaccttggccacctgaccgccgttgagatagcggatcaggtccaggaagatcgcggcggacatcaaccagaggtacgtcacgtcgtggtgccgtgcgtactgcccgccgaacagggtcagcgcgcagaagaacacccgcacccggtcgagcacgaagtccagccactggccgaagatcgtgccggtcccgttcagccgggcgatcttgccgtccatgcagtcgaccacgaagctcaggtggaacagcaccgcgccggcgatcagccagcgggtgtcgccgcgggcgaaacacaccatggcgccgaccccgatcaccgtggcgaccagggtcagcacgttcggggtgagccggcggtacggggcgatcaggcgcaccagccgggcggccagcgggtcgaccagcagcacggtccaccacgcgtcgatcggcttgtaggtgcgctcgcggatctcccgcagggtgactgtcactagggccctttctggtctccggggacaacgacccggcccgcgtccggtggccgtcacacccccggacgcgggacggttcagccgtgctcgcgaaggccgaggcgggcgtgcacggcgcgcagcgggcgcggtgcccaccagttccactccccggcgagccgcatgaacgccggcaccagcaccggccggaccagcagcgcgtccaggatgatcgccaggctggcgcagagcccgaagaactggatcagcgacaccccggaggtgagcatcgccaggaacgacacgctcaggatgccggccgccgcgctgatcacccggacgctgcgcgacatcccctcgaccaccgcggtgtgcaggtcggcgccctgttcgtgccgctcgatcacccgggacagcacgaacacctcgtagtccatcgagagcccgaacgccacgcagaacagcagcaccgggatggccaccgcgagcggggtcccggtctgcccgagcaggccggacaggtgcccgtcctggaagatccagaccgccacgccgaacaccgcgctcatcgtcagggtgttcagcagcaatgccttgatcggcagcagcacgctgccggtcagcaggaacagcagcacgaacgtggtcaccgcgatcaggatcccggcgaccggcagccggtcggcgatcgagccggtgatgtccaccagctgcgcggccggtccggtgaccagcgccgggtagcggcccggcaccggcacggcgcggaccgcgcgggccaggtcggcgcccgcgcccgagtacggctcgacgtcactgaccacggagaaccaggtggcgtcgccgttgacgtaccgcgggtcggcgtgccccggggcgatcacgatgacgccgtgctgataggtgccgaccatgctgtccacccggttcaccgcgggcagttcggagagccgcgcggcgtagtcggccgcccggatccgcccgtcggtcccgctgccccagtgctcggcgaccaccacggtggccccgctgccggtgtcggcgaactggccgcgcacggtgtccgcgaccacccggctctcggcggtcttcggcagcacccggtcatcggccacaccgaaccgcacgtgggtgaacggcagcgcgagcgcggccagcaccaggatcaccggggccgcggtgcgcaccgggcggcgcagcacgaagccggccagccgggcccagaaggtggaggaggcgcgcggccggtacagcgcccaccggtcgatccggtcgccgagcacggtgagcagcgccggcagcaccagcagcgcggcaccgaccgtggtcaccaccacggcgatcccggcgtaggcgaacgaccgcaaaaagtactgcgggaagaccatcaggctgctcagggccacggcgacggtcgccgcgctgaacaggatggtgcgaccggcggtacgcatggtgttgccgatcgcggtgcgcagatccgccgccgtgacccgctcctcgcggtaccggctcacgaacagcaggctgtagtcgacggccaggcccaggcccagcgcggtcgccatgttcaccgagaagaccgagacgttggtgatcgcggccagcagccgcagcgtgcccagcgtgctgacgatcgagaacaggccgatcagcagcggtgcgccggccgccccgacggtgccgaagaccagcagcaacagcaccagggtgatcgggatggcgatcgactcggcggtcgccagatccttggtgacctggtcgttgatgtcgttgttgatctgggtgaagccgccgaactcgaccttgatctgctggtcctggaagtcccggccgaggtcttcgtgcagcgcggccacccggtccgcactcgtgtcctcgtcgccgtcgacgtgcaccaggatcatgccggtgtcgtggtcgcggccggccagctgcggcaggtggttcgcccagtacgagccggccacggtcaccgcggggtcggcggccagccgctgggtgacccgttgcgcggcggcccgggtgtccgggtcgtcgacgctgccgcccggcttggcgatcagcaccaccaggttcggatcggcggcccggaagtgctcggacagcacctgccggccgcgtaccgaatcggtgttcggatcgtcgaaacccccggtcttgagcgcgctgaccacgtccccgctgaacgccaccgcgagaccggcgagcagcagggtgatgagcaggacgagcttggggaagcgggtgacgaaccgggtgaccgggccggccccgggcgcggcggcgaccggctggtcgccgccggcccggggcggcttggtggggagagaggtcatgtccggcggctgcctcaggccggctgcggcacgcgggccgggtcgaggtgccgggccagcaggtccacggtggtctcgatgtcctcgacggtgtgctcggcggtgacgaagaaccgcagccgggccagccgctccttgaccgccggatacatgatcgggttcgcgctgaccccgttcttgagcagcatgtcggccagcttcagtgccttcaccgagtcgccggtgatgcacgggaccaccggggtgccggcgctcggcccggtgtccagcccggcctgcttggccagccgcaggaaggtcgcggcccggtcgtgcagcaccttcaaccgctgcggctcctcgcgcatgatgtgcagggcggccagtgccgcggccgcgttcgccgggctcatgccggcgctgaagatgaagccgggcagcgtgtaccgcaggtactcgatcagctcgtgccggccggcgatgtagccgccgcagctggccagcgacttggacagggtgcccatccagatgtcgacgtccttgcggtccaccccgaagtgctcgccgaccccgccgccgcgggcgccgagcacgccgatgctgtgcgcctcgtcgaccatcagcagcgcgccgtgcttcttcttcagcgcgatcagcgccggcaggtcacagatgtcaccgtccatgctgtacacgccctcgacgatgatcagcacccggcggtaccggtcgcggatccgggtcagcagcgcgtccagggcggccaggtcctggtgcgggaacggctggcggttggcaccggagagccggcagccctgcaggatgctgtcgtgcgccagcgcgtcgtgcacgatcaggtcctccgggccgaccatgtgcccgatgatcccgacgttcgtcgagtggccaccgagcagcgagatcgcgtcctcggcgccgaccagcgaagccaggctgcggtccagctcgtcgtgcagcgcccggttgccggacaggatgcgcgcggccgagaccgaggagccgtaccgctccaccgcctccttcaccgcgtagttgaccatcgggtgcccggacagccccaggtagttgtagctggagaaggagatcaactgacggccgtgcaccgaggtgcgggcgttgatcacgctgtcgtgcacgatgtagtacgggttggccaccccgacccgctccaggatgttgccgcgcgcctcgaactgcacgacctccgggagcttggtcacgtcggcgacctcgggccggcggacgtccccggcgcgcggcaccaggtcctgcaccggctccggagccggagtcgcggccggggccggcgcactcacgcctagcgcctgctggagcagctgcaccagctcgccgaccgtctcgatgccgaagacctgctccggggcgaggtcgagatccggccagcggcgcttggccgcggcgatcagttcggccgtcatgatcgagtcgaagccgaggtcggcgccgaacgtctggtccgggcgcacggtgtccgccgggtaggcgctgatcttgccgaccatcgccgcgacctcggtgaagacctgcttgtcctcggtcttgcggggctgctgggcggggaccttcggcggggccgccttctcgggcgcctccttggcggccggcagcgccggtggcgccggtggcgcggccaccacctcggcgaccgctccggcggccggctcggcccccggctcggcgccgatgtcgcgcagtacggccagttgttcccgcagcagggagatgacgtcgttcacgggggtctgcgctccgttcctgattccggtcgccggctgagcctcgcgccgggttggcggcgtctcgcgcaccgcggtctcttttttgctgacaaatcggcttaacgacgcactgcccggtgtacgacggatcgagtagtgctgagttgccagcggcgacggcgggagtgtggccaacggcacaccgagcccctcgaacagcggcgtgaggttcaccggcacgccggccaccgccagccgtcccagaccctccaacagggcatatccgtcgtccggctcggccggcatcagcgcgatcgcatccagcccccgcgccgccggcgtctgcgccgccatgccgagcagcgcgtccccggccgacacctggaccaggatcttcgccccgacccgcaccgcctgatcgatcgcgtcacggaacagcaccggcgccgaaccctgccgggcccagagcgcgcgcagcgtctccgagtccgtcggcgcggccggatccacactggagaccagtgtccggatcggcttgcgcaccggcagcccggccacgaactcaccgacccgcagatccacctcggacatcaacggcgaatggaacgcgtgcgacacgcgcagcggcgcgaccggcacatcccggtcccggcagcgctcgaccagccggcctaccgcgtcccggtgcccgctcgcgacgatctgcgtcggatggttgtaacagcccgcccagaccccgtcgatcccgatccgcagctgctcgaacccggccgcgtcgatccgcaccgcggccatcgtgccgggcggcggttcctccccggaggtcaccgcggcgccccggtcgatcaggaactcgatgccgtcgtccggggtcagcgcccccgcggccaccgcggcggccatctcgccgacgctgtggcccagcgtcacctccggggtcacccccatctcggcgagcagctgggtcatcccgatgccggccacccccaggcccggctggcagatccgggtcgcgctgacccgctcctcgtcacccgggttcggcgtgtcgcagagcaggtcggtgaccggcgcgccggtccgctcgtccacccggtcggccagcggccgcacgtgctcggccagcgccgggaaccgggccaccagatcgcgcagcaccccgggacgcagcgagccctgacccgggtagaggaaggccagcgaccgctgctccggcgccagcggggcggtgctcgcgtacaggccggcggccagccgtccggtcgcaccggcggccagctcgcgagccgccacggcgagccgctccgccaactcggcccgggaccggcacatcaccgcgagccgcgcggtcagcagggaccggctggccatcgtgcgggccaccgcggccggggtcagccccgggtccgcggcgatcaggaccgacaacctctgggcgtacgacgtgagcagctcaccgttgtccgccgagatcagcaccacccacgggcgggtgccgtccgcgtcgtcaccgtccgtctccggctccggggcctcgctgagcaccgcgtgcacattggtgccgccgaagccgaacgagctcaccgcggcccgccgccggtcgtcggccggctgcggccacgacttcggctcggtggtgatggacagacccgcctcggccagcggcagctcactgtgcggatccatggccgccggctgcggcggaacggtccggtggtgcagcgccagcgcggtccgcagcacgcccgcggcgccggccgccggcagcgtgtgcccgatcatcgccttgcccgaggacaggtagcagggccggtcggtggccttggcccgcacccggcggatcgcctccacctcgaccctgtcgccgaccgtggtgccggtgccgtgcgcctccaggaagtcgatcgagcccggctcgacccgggcgtcgcggtacgcggcccgcatcgccgcctcctggccctcggccttcggcgtcatcgggccggcacccttgccgtcgttggcggtgccgatgccgttgagcaccgcgtagatccggtcaccggcctccagtgcgtcgtccagcgggcgcagcacggccagcgaaccgccctcacccagcacgaacccgtcggcccgggtgtcgaacgggcggcacaccccggccggcgacagggcgcccacccgggagaagccgaccagcgcgttcggcgtcaggttgaggaacaccccaccgaccagcgccgcgctgcacgagccggtgcgcaggtggttgaccgcctcgtgcagcgcgaccagtgcggaggaacaggcggcgtcgatcgcgaaggacgggccgcccaggtcgagcagctcgctcaccgtggccggggccatgttgagcagcgacccggccatcgagaacgactgcggcgggtcgatcgccagcttggccgcctcggcgatcgcggcgagcagcgccggatcgtcggcggcgctcgacagcgacccgtcggcgagcaggctcgcggtcagccgggccccggtcagatccttgtagtcggcggtgctgaggccgacgaacaccccggtggtcgcccggtcgaacggccggcgctcccagccggcgtcctggacggcctcgcgggccaggtccaccaggagccggtgttgcgggtccatggccttggcgcgccgtggcgggatgcggtggtgcagggcggcgaacttctcgacctcgtcaagaaaggccacccggtcggtgtacgtggaatgtgtatcgcgaaaattcgtcgaatagaatgtttcgtgattccaccgagccgacggtacgggccggaattgatgggccgcggccagcgagttcgaccagaactcgaccacgtcgcgcgcccccggaaaacggcaggataggccgacgatggcaatgtccaatggatgttcccctgcttgcgtgcctgatggtccgccggacagcggccagggaagcgctggaagagccgatggaagatcgtcggcaggtgcgctttgtgcccagaggctaactcacgccgggatgatttcgcgcaaggcgacacgcggtttcgaaagaccttctgcgggtcttggcaaaagatagaacaccggcacgccacatggtgtgatcttgccctctgaatcactccgggggagtactcacgtgtcgcttccggcggatccggacgttgaacagatgcaggtcaggggggattcggttcacccgtgagtgtgtcggtttgggtaaaacgcccgcttcgcctagttttgtgcgtcatgaagcacacgaccatgcggtggctcgctgcagccgtggcgctggccggcctcgccgcctccagccccgcccaggcggccccgtcgcaacctcgattcgcacccatccgcatgaacgccacggcgtactacggcacgctcgacgtcatcgcccgcgagacgctcggcctgaaggcgcacttcaccacctgggacggccacccggtcgccgggcttcccatccagttcaccaccaccggtgaacgcttcccgatgtgcgaggccaccaccgacttcgccggctgggccgaatgcaagaacggcccggtcccgccgccggtgtccctggcgaacctgctggtcaacggctacgacgccgtctggctcggcaaccgccggttcgccccggtcagtgcccacaacaacatcggcatcggctgacctcccttcaaccagtagcggccacggggcgcgcctcagcgcgcgcccccggcccgccagcgcggccggctcggcccgcccgccgcgctagctagctagcccggcggccccgcccgccccgccacgctcactgctctcgctgcgtcacacgcgcccggccccgcgcaggtcggtgccgacctcgtgcagatgacgcagggcctggcggtaggactcgacgagcccggtcatctcgtagggaaccccgatctccgcgcagtagcgccggacgatcggctgggccttgcgcaggttcggtgtcggcatcgccgggaacaggtggtgctcgatctgatagttcagtccgcccagcgccgcgtcgacgagccggccgccgcgcacattgcgtgacgtcaggacctgcttgcggaggaagtcctcggtgccgtccggatgcggcatgcccttgtggttcggcgcgaaggtcagccccaggtagacgccgaagagcgcctgatgcaccacgaagaacgccagcgcctgcacggggctcagtaccagcagcagtgccgcgacgtacccgatgaaatgtgccgtgagcagcgtgaactccaggccgcggcgtttcacggtgccgtccagcagggcgcggacactgtcgtgtttcagcgagatcccgagcagggtgagcagcgggaagaagaaccaggcctgatgccgggtcaggaagcccctgccggccgccgcctcgcgggaccagaccagcacgcccggaccgacatccggatcgaggtcgtcgtggttcgggttggcgtggtgcttggtgtgcttgtccatccagtacccgtacgacatgccgatcgccaggttgccggcgatcaggccggcccgggagctcggccggttggtgcggaacacctgccggtgtgccagatcgtgcgcgaccagcgccacctgggcgttgaccaccgccagcaggaccgccaccgccagcgtccaccatgatgcgccgagcagggcgaacgctgtccagccaccgatcagggcggcggccaccaggcccaggcgcagcgcgtaatagcctgggcggcggcgcatcaggccggccgcgttgatccggcgactcagctccgcgaagtcacttccggcggcacgcggccgctccgtcatcgtcgtcatgcccaccagccaaccggttcggcggcccggtttcatcagtgctcaccccctaatcgaaggccgggatcacccccgtttcaggggtagggctggcactaccgacaagcgggcgggaacgcggcaggatgatgcgcatggactcgcgtgactggatccggaacgggctccgggccgtgctcggcgggctgctgggcattccgctggcggtgctcaacctggtgctcttcgcgttctcggtgatcgccctgatcctcagcgtggtgcccgggctcggcttcgtcgcgttcccggcggtgacccggctggtccgcgcccgggccgacctggcgcgccggctcgacggccgggtcggcctgccgatcgcgcgaccctacaaacccgcacccgagcgcgcccgcctcggcggctggcggcactaccggtggatcctcaccgaccaggccacctggcgcgacctcgcctggctggtcccgggcgcatcgatcggcgccgtgctcggcgcgttgatcatcgcgctgccgctgtacggcctggagggcatcctgctcgtcccgttgtgggtctggctcggcacagggtggtacggatacggggtcatctggccgttcgacaccgtcggcgacgcgctgctctccctgccgcagggcacgctgttcctgatcatcggggtggccgcggcaccctacctgccgcgtttcggcgcgctcttcgaccggctgctgctcgccccgacccgcaacgccgagctgcgcctgcgggtcagccagctcaccgtcacccgggccgacacggtcgacgcgcaggcggccgagctgcgccggatcgagcgggacctgcacgacggcgcccaggcccggctggtgtcgctgggcatgacgatcggcctggccgaggagatggtcgaggccgacccgcgcggcgcgcgccggctgctggccgaggcccgggagaacagcagcgccgccctggtcgagctgcggcacctggtacgcggcatccacccgccggtgctcgccgagcgagggctcgacggcgcggtccgggcgctggccctggcgctgcccatcccgaccactgtggaggccgtgctgcccggccggctggacacgccggtcgagtcggcggcctacttcgcggtggccgaggcgctggccaacaccacccggcacagctttgcccgggtcgcccaggtggagctccggcacaccgggaacgccctggtcatgcgggtcagcgacgacgggctgggcggcgccgacccgaccggcggcacgggcctgcggggcatcgaacgccgcctggccgccttcgatggcacgatgagcctgtccagcccaccgggcggaccgaccgttgtgaccatggagttgccttgcgtgttgtcctcgccgaagatcacgccctcctccgggacgggctgacccgcctgctgaccgcgcacggctgtgcggtggtgatcgctgtcgacaatggaccggcgctgctgccggccctggtcgagcaccgaccggacgtggccgtggtcgacgtgcggttgccgccgaccttcaccgacgagggcctgcaggcggcgatcgcggcccgcggcgtgctgcccggcatgccggtgctggtgctcagccagcacgtcgagccgctgtacgcccgcgagttgctctccgaccgcagcggcggggtcggctatctgctcaaggaccgcgtctcgcacgtcgcccagttcgtcgacgcggtccgccgggtggcctccggcggcaccgtcatggacccggaggtcgtccaccagcttctggtccgccgccggtctccgctgtccgccctgaccgcccgggaacgcgaggtcctcgggcagatggccgagggccgctcgaacggcgcgatcgccgccagactcttcatcggggagaaggcggtcagcaaacacatcaacaacatcttcaccaagctcgacctgccgccgtcggacgacgacaaccgccgggtcctcgccgtcctcacctacctgaacccctagtcccggcccccgcacccctgacgtgcacccctgaccttcggtggcgcggcccgcccggagccggcgacgtatgaagggctgccggccggccggcccgcgggaggaacgagaagcggcgccagggccggccactagaaggagagacgggcgacgcggccctgttcgccggaggcccagcaggccagccgggtgcaggcgaccgcgtcgaagctgccggtgtcgaatcggtgccaggtgaccccggcgttccaggagatgtcgctgccggtggggccgacggcgagggcgatcggcccggcggcccaggcgacgccggagcggtattcgccgggcggggtggtggcggtcgtccaggcacggccgttgcgggtgaaggcggctccggccggggccgcggcgggagcggtgtagtcacctcccacggccagcccgttgccggagtcgcccgaggaggggccgttgcgggagtcgcggaaggcgagcccgtagattccggcgctgggaccgctcgggatcccggtggtggtcacctgccacgtccggccgaggtcccgggagctgaacacccgggaggtcgcgccgccgccggtggcgaagtaggcgcgcccgccggccgagaccaggcaggtgccgctggcggcgaaggcgaactcgccgtcctgcgcggccggcattccggtgtccgggaggaccgaccaggtgcggccgccgtcgccggtggcgaggatccggaacctgccgccgaccggatcggacagggccaggccgtggcggcggtcgaggaaggtgaggcagtcgtagaaggcggcggcgtcctcgttctggaacgagcgggtccaggtgtggccgccgtccgcggtggtgtagatgcgcgagtcggtgccggtgccgatggtcagggcgaccgcgtgccgggcgtcgaacgcctcgatgtcgcggaactgcagggcggcggcgtcggccgggccgaccgagatccacgtgcggccgccgtcgacggtgcgcagaatggttccggcgctgccggccacccaggcgacggtggcgctgaccggggccagaccgcggaaccgcgccgtcgtcccggtcggggtgagtttccaggaggcgggggcggcggaggccggctggggagtggcgagcgccgcgacgacagccagaacgatcgacaggcttcgtttgaacgtcatgcttgcacaacctaccgaaggctagttgccgagtttggcgcgcaggcggacggtgtcggccacggtccagcccggcggcggggcgaccgtcgcccatccgtccaccgtccccgacttgtagacgtgcccgtgtccggtcggcgcctggttggcgaagaccaggtcgcacgtcgtctgccagaacgtcacccacgggaaccagtgcatggacggcatcacgtccggcccccggtcgccgcggagccacggcggccgcttccagagcaggctccagttccaccagacgatcgggtcggacgagttctgcaggtacaccacccgaggccggacgcccgcctggtcccggagttcctccgcggtgtccgcgaagccgaccggcagcgacgggtacaccgggtcccacaccggcgacctgccggcccggtcccgggtgagccgccggtggatcgggttggcgaaggtgggcccctccatcagcaccccgtccgccccgttcaccaggccggccgcgtcgccgtaggtggcctcgatcccgtatgtgccgaggctctcaccgaacagcagcagccggggccggtggtcggcgggcagcgtcgaccagcgcgcccgtaccgcggtgatcagggcggacgccgcgtcgaccacctcggagcggtcgccgaggaaggcgatccagctgggcaggtacgagtactgcatggagaccagggcggtgtcgccggcgtacatgtattccagcgactgggtcaccttgttgtcgacccatccggtgccggtcggggtgaacagcgccaccaccgagcgctggaaggcgccggtccggtccatctcgcggacgatcaggtcggcccggtcacgcatggtgccggcggaggcgagcccggcgtacaaccggatcggttcctgtgcgggccggcccacgaaatcggtgagctcctgccggctgggggcgctggcgacgaagttgcggccctgccggccgagggtgtcccagccgaccagggattgcgagctgccggagcgcagcgccgaggcgggcacgtgcaccccgttgccggtcccgctgttgatcacggcggcggaccggtcggcgaccgcgaacaggtgggcgaccagcaggccgtcgaacgcgccgtagctgagcacggcgaccaccacggtgccggcgcagtaggcggcacggtccggcacgatcagccggaacacctgggcgcagccgtgggtggccagccgcagggcgcgggcgatcagcagaagcagcccgaaggtgagcaggctggcgccgacggtgcggacgatgtcgtactcctgggccggggccatgcccagccgcatccgcaactcgcgctgccagcgcacgccgagcaccaggcaggtggcgatcatcgggagcagcagcacggccagcacccgccaccagatccgcacgacgcggggggagaaccggaagcggaggcggatcagcgcgccgatcgcggtgcccagtgcgtaccccatcgccgcggtgatcccggcgacgacgccctgcaggatgccggtgcgggggagcagggacggggtgaaggcgaggctgaagaagacggcggccagcccggcgccggtgaggctgagcggggcccggatgatccgccgggggttcgggacggggatcgccgcgaacggtacggcgggccggcggggccgcgggatgcgagctctcagcgacgcgggtgaaacctgcatgcagtgctccgatcatcgacgggggaacgccggatccggttaccactccatcatcaggggtcgatgggcgccagcgcggccggcgttttgccgccgcgggttcattcagccggggcttccgctgccgatgacaagcagtgaggaggaggctcgatgcgggtacggaactggatcgcggtggtggtcagcgtgctgctgctggcggccgccggcggtatcgcgatcgtggtgaaccgttcggcgctgaacgccgccgacgcggtgcatcgcgctgacagcaccgagctgggcaccaacaacgccaccctgaccgggcagcttcagctgctgtccgcccaggagctggcccaggtgctggccgagcacgtgttccggctgagcgccggcgatccggcggaccaggccctgctggtcgcggcggcgatcaagagcagcaccttccagtacgggatgatgctcaccgacgcgaacttccggccgctcaccgccagccgcagctccggcatgccgccggtcaccgccgccggctgggcgccgctgatcaagcagttcaaggccggccggcaggtcggcttctcctcggtgatgaccgtggacaggatcccgctggccgcggtggcggtgccgatcgtggtcagcggcgcgatcgtcggattcctggtcggcttcaaccaggtggccgccacctcgctgcagcactacaccgagcagctggccgacgagagccaccggacggacgtggtggacaccgccggcacgatcgccgcgagcagcgagcagggcacggtcgggaaacggatcgacgatgcgatcatcgacgcgctgggccaccccggcacccggttcgtggagtaccggtccgggtcggtgccgatgatctcggtcctggtgggcggcctgccgagcgggtacacctacgtccgtacgcagaccaagtcgtcgttcgacggtgcggtgcaccggcgcagtcagacggtcaatttcaccctgctcgccatgctgctgatcggtgtggtcggcatctcggtgctcggttaccgcacccagatccagcggcgccgggccgacgagcggttccaggcactgttccagcacgccccggacatcgtcacggtgatcgaccgggacggccggatgatcttcacgagtcccagttcggcggcgatcctcggtttcgagccgggcctgctgaccgggcacagcgtcttcgacatggtgcatcccgacgatcagtcggcgatgcgcgagaagctgacggcgctggtcgccgacccggccggggtactgcgcctgcagtgccgggtgcgggcggccaccgggcactaccgatggttcgatttcaccgcctcgaaccagatggccaacccggccctgaacggcgtggtgatcaacgcacgggacatctcggagaaccgggcgttccaggagcggctggcgcacgaggcgcagcacgacccgctgaccggcctgccgaaccggcgccggatgcaggacgcgctcagctccacgctgcgccgcgacccggtggccgtgctcttcgtcgacctggacgggttcaagccggtcaacgacgcgtacgggcacgaggccggcgacgagttgctgcgtcaggtggccgatcggctcagcggctgcatccgggccggggacgtgctggcccgggtcggcggggacgagttcgtggtgctgatgcccggcgtgctgggcccgaacgacgtggccgcgatggcgaaccgggtgcgggccgtggtggagatgccgttccggatcgccggccggcacatcaccatcggcgccagcgtcggggtgcacctggccggtcccgcggaggatccggattccgcgctgcgcgccgccgaccacgctatgtacgagatcaagcggtccggcgggagccgtgccctgcgggaggcgctggcgagtgtcgggaggcaccgcgcgcccgacgaaggttagtgcacactgggtgcatgaattctagggtgctgtcccggcgtgatctcgacttcctgctctacgaatggctcgacgtcacgtcgctgaccgcccgggagcggttcgcggatcactcccgggagacgttcgacgcgttcctcgacgtgtcgcagcagatcgccgagcgcgacttcgccccgcacaaccgcaagagcgacctgaacgagccgaccttcgacggtgagcgcgtgacgatcatcccggaggtcggccacgcgctgcgggtgttcgccgagtccgggctgctcggcgcgaccatggacgccgagcacggcgggctgcagctgccgcacgtggtgcagcgcgcctgcttcctctggttccaggcggcgaacaccgccacctccgcgtacgcgatgctcaccggcggcaacgcgcacctgctgctcgcgcacggcacgcaggagcagatccggcggtacgtgcacccgatgatcgaggggcgctacaccggcacgatgtgcctctccgagccgcaggccggttcgtccctcagcgacgtcagcaccagggccgtacgacaggaagacggcctctatcggttgaccggcggcaagatgtggatctccggcggcgatcacgagctcagcgagaacatcatccacctggtgttggcccgggtcgccggcgcgccgcccggggtcaagggcctgtcgctgttcatcgtgccgaagaagctggacagcggcgagcgcaacggggtgacgctggccgggctcaaccacaagatgggttaccgcgggaccaccaacaccgtgctggccttcgacgatgcgctcggtgagctggtcggcgaggagggtcgcggcctgcagtacatgttccacatgatgaacgaggcgcggatcggggtcggctccggcgcggtcgctctgggctacaccggctatctgcacgccctcgcctacgcccgggagcggcagcaggggcggccggtcaccgcgaaggacccggccgcgccgccggtcccgatcatcgaccacgcggatgtacgccggatgctgctggccggcaagacctacgtcgagggcggtctggcgctggtcctgtacgccgcgaaactgctggacgagccgtccccggagcacagcctgctgctcgacgtgctgaccccgatcgtcaaggcgtggccctcgcagtggtgccggctcgccgacgacctggcgatccaggtgcacggcggctacggctacacccgggagtacccggtcgagcagttctaccgggacaaccggctgaactcgatccacgagggcaccgacggcatccaggcgctcgacctgctcggccgcaaggtcaccatgcacggcggcgccggcctcaccctgctgctcgaccggatccgcgcggtcgccgccgcgtcgcccgccgacctcggtgacccggtgcggaaagcctgcgaccggctcgccgcgaccaccgcgaagctctgggccgatccggcgaccgcgctggccaacgccaccgcctacctggacgccgccggccacctggtgatcgcctggatgtggctcgaacagctggcggcggccggggaccggccgggcgacttctacgccggcaagcggctcgccgcgagatacttcgtcacccacgagctgccccggatcggcccgatgctggacctgctggattcgggcgacacgctgcttctcgaccttgaggacgcctggttgggttaggttcgacgcatggccggtaaagccaccgtcatcgaagtcggcgaccacgacgtccgggtctccaacccggaccgggtctacttcccggagctcggcgccaccaagctcgacctggtcgagtactacctggcggtgagcgacgggatcgtccgcgcgctgcgtgagcgcccctgcatgctgcaccgcttcccggacggcctggccggggagaaggtgcaccagaaacgggtgccgaacggcgcaccgccctggctggagacggtccgggtgacattcccccgctaccaccggtacgccgacgagctgtgcgtgaccaagccggccgacgtgatctgggcggtccagatgtccaccgtggagttccacccgtggaactcccggcgggcggacaccgagtgcccggacgagtggcgcatcgatctggaccccatgccggactgcccgttcgacacggtccgccgggtcgccccgatcgtccgcgaggttctcgacgagctcggcatcgcgggctacccgaagacgtccggcggccggggcctgcacatctacgtccggatcgagccgcggtggggcttctccgacgtacgccgcgccgcgctggccttcgcccgcgaggtcgagcgccgcgccccgcgggacgtcaccaccacctggtggcgcaaggaccgcgacccgtcggcgctgttcatcgactacaaccagaacgcccgcgaccacaccatcgccagcgcctactcggtccgcggcgtcccggaggccaccgtctccaccccgatcacctgggacgagatcgccggcgtccagccgcgcgagttcaccatccgcaccgtcccggcccgcttcgccgagctcggcgacctgcacgccaccatcgacgacgtccaccaccgtctggacaccctgctggagtgggccgaccgtgacgaacaggccggcctggaaactcccgaggaaccggagggaacctgacccggaccggaccttgcggccggtgggcacgatcggctcatgcgtcaaccgtcggagcaggtgcgggccggggccggggtgttcgcccggtccggggtcctgttggccctgatcgccgttctcacctgggccggcgagggcgtcaacggtgtctgctcccgcgacgacggggcggttgccgggctggcgaccggggtcgtgatcgcggtactgggttatccgctgctgctcgtcgccgggttccggcgcacccggcgtaaccgggcccggcgcggtctgctgatcggctggtcagccgccctgctcgtggctgtggctctgatcctggcggcaggagatcacgttcgcgggctcccggccggctgcccggtctgacgagtacgaccggcggtgctctcccggatgatcagcttgtgcggggcgcgcagctccagggccggcggcggggtcgggctgtcgatccgtagcagcaggcgttcgacggcggtggtcgcgatcatctccttgtccggggagatggtggtgaccgacgggttggcgtaggcgccgtcctcgatgtcgtcgtagccgatcaccgcgacgtcctccggcacccgcagcccgcgccccaccagcgtgtggatcgccccgagcgccaccaggtcggagtagcagaagacggcgtccggtgggtcggcccggtcgagcagatgggccatcgcctgggcgccgtccctgcggttgaaccggggcgtgccgatgatcaggtcttcgcgggcggccagcccgcgcgcggtgtgtgcctcgcggaagccgcgggtgcgcagctgggccgcctcgccgctggcgtagggctggtcgccgatcgcggcgagccgccgccggccgaggtcgagcaggtgttcggtggcctggcgggaggcggccacgtcgtcgatgccgacgtggtcgaaggtgccgtcgctgctgcgttcgccgaggacgaccagcggaaggtgcgggtcgtggtcggcgagcgcctgctggtcgaggccgagtgggctgaagatgacgccgtcgaagagcagccggcgggagccgtgggcgatgaacgcgcgctcgtgttccggatcgccgtcggtctggtcgatcagcacgttgtagccgcgcgcccgggccgcccgcaacacgctctgcagcagctcggagaagtacggtgtgtccaggtacggcacgaccagtgcgatctgcccggaccgcccctgggccaggttgcgggcgagcacgttgggccggtatccgagttcctcgacggcgcgctgcacccgggaccgggtccgttcggtgacgttcgcatacccattgaccacgttggagacggttcggctggaaaccccggccagctccgccacgtcacgtagcgtgacttctcgacgcaatgtgccccctccgaccgcgccaagcttccggcaggttacccctcgccgtcgatggacgtccgtgcctgctgttcgagcactactccccggcgttcgaggatccgctggtccgccagagtgtgctccgggtggtcgggttcgggctggtgcagaccccggtgatgatcgggatggcgctgctcgcggcgcccggccccggtcaccgtgctgttgttctcgatggccgcgtcgtggaacaacttcttcctgccgctggtgatgctcagcgacgaccacctcttcccgctgaccgtggggttgcggacctggtacatgtccgcgattctcggcaacggcggcgaggcgctgttcaccgtgatcgtgaccggcgcgctggtggccatcctgccattgatcgccgccttcctgctcctgcagcgttactggcgtggtggctcgaccatcggcgccgtcgaacaggcttcttcgcttcggtcagagggaacaacatgctccgtgcgcgtgtcgcattgaatccgggcgccgtcgtggccccggtcaaccgccggaccttcggctcgttcgtcgaacacctgggccgctgcgtctacaccggcatctacgagcccggccaccccggcgccgacgaggacggcttccgcaccgacgtgctggcgctggcccgcgagctgggcgtcaccacgatccgctacccgggcggcaacttcgtctccggctaccgctgggaggacggcgtcggcccgcgcgatcagcgaccccgccgccgtgacctcgcctggcgcagcatcgagaccaacgaggtcggcatcgacgagttcgcccgctgggcgcggaaggccgacgtcgagatcatgtacgcggtcaacctcggcacccgcggcgtccaggaggcgctcgacgtgcacgaatacgtcaaccacccggagggcaccgcgctctccgagcagcgtcgcgcgaacggggcggagaagccgtacggcatcaggatctggtgtctcggcaatgagctcgacgggccctggcagatcgggcacaaggccgcacaggagtacgggctgctggccgccgccacggcgcgggccctcaaatccgccgaaccggacctcgaactcgtcgtgtgcggcagctccagctcgaccatgccgaccttcggcgcctgggagtcgacggtcctggagcacgcgtacgacgtggtggaatacgtctcctgccacgcctactacgaggagcacgacggcgacctgggctccttcctggccagcgcggtcgacatggaccacttcgtgaacagcatcgtggccaccgccgacgcggtcggcgcccggctgaagagcaccaggaagatcaacctgtcgttcgacgagtggaacgtctggtacctctcccggttccagaacgcgccgctgccgaacgagtgggaggtcgccccgcgggtcatcgaggaccggtacaacgtggccgacgcggtggtggtcggcaacctgctgatctcgctgctccggcacagcgaccgggtgaccgcggcctgccaggcccagctggtcaacgtgatcgccccgatcatgaccgagcccggcggcccggcctggcggcagaccatcttccacccgttcgcccgcaccgcggcgctggccaagggcgaggtgctggagacccgggtggacagcccgacctatcagaccgccagatacggcgaggccgacctggtcgacgcggtggcgacccacgacccggcgaccggcgacgtgacgctgttcgtggtcaaccggtcgcaggacgggccggtcgagctgaccgtggacctcgccgccttcggcgccgggctcgcggtcggcgagtcggtcactctcgccgacgacgatgtacgggcggtcaacacccgcgacgacccggagcgggtgaccctgcacccgaccgccggcatcaccgtggacggcactacggtgaccgtcccgctgccgcgagtgtcctggacggcgctgcgcctgagccgctgacgtcgtggcgcatcggttctccccgatgcgccacccggtcttccggctttcggcgaaaaattgttatccgccaccggaaaaaacgtcgacgttaaagcaaccttaaacgatgcccgggatcggcctccggcttcccataatgggaggccccgcaccgatctcccggaggctgtttccgatgcgccggaaaagaacattcctgctgacctcgctggcgaccgtcgccgcgctcggcaccgcctggttcgcgctgcccgcctcggccgcgtccgccacagccaccctgcgtaccgtctccgactggggctccggctggcaggacgaggtggtcgtgagcaacgacggccggtccgcgatgacctcctggaaagtcgaattcgacctgcccgcgggcacctcgatcggcagtttctgggataccgacatggcggccgccggcagtcaccgcacattcacgaatcgtagttggaacggcgcgattccggtgggccagtaggtgacgttcggcttcgtcgggtcgggcgcgcagccggtgaactgcaagctgaacggcgccccctgcggcgactcggccccggtgccggtccccaccaccgtccccgcttcccccaccgcgcccgccacccctgccgtccccgccacctccgctcccgctacttccggtcccgtcaccacctccgccccggccaccatcccgccgagggaggctctgctcccggtcacggtgaccaacaagaccggccgcggcgacgccgtccatctctacgtcctcggcgtcaacctggacaccggcaaactcggctacgtcgaccgagcaggcaggttcaccgcctggtccggcggtggcgccgtcccgctcgccgccccggacgtctccatccccggaccggccaccggcgccagcaccaccatcagggtcccgcgcaacctttccggccgcctctacttctcgttcggccggaaactcgacttccgcctcacccgggacggcctggtccagcccgccccgtgggcggccggcgacccgaaccacgacatcctcttcgactggagcgagttcaccgtcaactcctccggcctgtggctgaacagctcccaggtcgacatgttcgccgtcccgcacacggtcagcgtcaccggcggctcgggcacgaccagctccaccggcaccccggtcgcgaacggccgccagcgggtgatcgacgcgatcaaggccagccccgacttcgccagaagcgtcgtcacccgctccgacggcaccgtcctgcgggtcctggcccccggcaaggccgccgacgccggcctgatgagccccacctatctggacccgtacatcgccaccgcgtggaacgcctacaccggcaggacgctcaccgtcaccccgttcaccgaccgacccacggtcagatacctcggtcgtacgtccgggaacgtcatgtccttcaccgacccggccggccgggtggtggcgtccttcacccgcccctccacggccgacgtctggggctgcgacggcgccctcggcgccccgaacgaccaggtcgtcggccccatcgcccgcaccctgtgcgctgcgctgcagcgctccacgctgggccgcatcgacacccagccggccggtcgggccgccgacttctaccagggcaacccggccaacctgtacgccaaggccgtccatgccgccatgctcgacggcaaggcgtacgccttcgccttcgacgacgtcctcaaccaggagtccctggtccacgacggcgacccccgcaccgcggcgatcaccttcaccccgttctgaccggtacgctccggctccgcacggacgggccgcgccgcaacccggcgcggcccgtccgccgtcgtttcaccggaccgtcgggcggcccacgtcgatccgggtctccccggtcaccgaggtgtcccatccgacggcgacaccggcgccgtgccggatggtcagcgtcgggccgccgccccgcaggctcggcgtccgcagccggtcggcggccagacgcgccaccatgccgtccgggacgagcacgctgacgtcgacgccgtcgaccgcccgccggaccgcctcccgcagtgcggccgtcgcctcgggcgtccccccggaccggcggtggtcgaggatcgcctgtcgcaccgggggcagtgcgacgacggcgccgaggtcggcggtgcaggacgggatccggtgggtgaacacgctgtgctgacggcttccggtgccgatcgagacgccgctggagcggatgatccgggtctgcatgccgtcggtgcccgtggcccgcaccggctcgacgctgtggaaccacgcctcggtgtcggccgcctcgtcgtagtcgagcagcgacgcgacctcgatcaccggtcgctcgacggtgcagcggtgcacgacgtgcaccgtggtgccgcagccgtagaccacggcgcggctgtcgcggatggtcaggtccgctatcggacgccggggcgccgacccgtcgaggccgccggccggcccgggaagcgtccggatctccggctcgccacggttctccagctgctcgatcacggtgtcgagcagatccgtcatgctctcgggatcgtcgtgccacgcgtgttccactgcgccgagctgccggcaggcccggtcgatctcccgcaggcacgctcggatgtcggtccggcgcagctcggccagccgatcggtgagcgcctgcggatcggcgaccagcggcagccgtccgacccggacgatcaggtcgtcgagcctgtcgagccgggtctcgacgacccgccattccgccgtcccgctcggcgcaccggccgccagcgtcgcggcgacggagcggtcgagctcgcggagcagggtgagcggggagtcggccgcggcgtcggtcgtcgcgtcggtcgtcgcgtcggcaatcgcgtcggccgcctggtcgagcggtgaccagggttgcgggctgaacggctcgaccggctgggagaggtgctgttcatcgatcgccggtccggacggggaggaccatgcgaaggtgcgaccgggcggtccggtggtggggcgcggggccggccgggccatttccgacatgaacccattctggcgccccgatcgcgctctggccgggaactcgccacggaaggcgccgctaccgggccgaggcggcgggccgtgggcgcgcggcggcggcgcaaaaggcgagagcatggcttgtgcacgcgcgatatagaaagatatcgttcgagcttgtcggtatgtgtgcggctcggcggcaagtggaggctgcgatgaagcatccgggttctggctcgcgatggatgcggatcttgatcggcgccgcgctggtggtggcgatgtctccggcgccggtgcacgcggcggcggccgccccgaagccgaaactcgcccattcggtcaccttcgacggctattcgttcctgatcgacggccggcgcacgtacctctggtcgggggagttccactacttccggctccccagcccgagcctctggctggacatcttccagaagatgaaggcggccggcttcaacgccacctcgctctacttcgactggggttaccactcgccggcgcccggggtttacgacttcaccggcgtgcgggacgtcgacctgctgctcgatatggcccaacgggccgggctgtacgtgatcgcgcgaccggccccgtacatcaacgcggaggtggacggcggcgggctgccgggctggctcaccaccaaggacgaacagaaccgcaccgacgaccccaggttcgaggcccacgccgacgagtggctcacccagatcgaccggatcctggcccggcaccagttgaccaacggcaccggctcggtcatcgcgtaccaggtcgagaacgagtactacaccggtaccacagccggccgggcgtacatgcagcacctggaggacaaggcgaaggcggacggcatcacggtgccgctgaccggcaacaacaacggcacgttcaactccgggacgggcgcgctcgacgtcgacggcccggactcgtacccgcagggcttcaactgctcgaacccggccgcgtggcagggcgtgccggacatcagctacgaccaccctgccgggcggccgctgtacacgccggagttccagggcggcgccttcgacccgtggggcggccccggctacgacaaatgcgcgcagctgatcaacgaccagttcgcgaacgtcttctacaagaacaacatcgcggtcggagccaccgcgcagagcttctacatgacctacggcggcaccaactggggctggctgggcatgccggagaactacacgtcctacgactacggcgcggcgatccgggagacccgccagctcgatccgaagtactaccaggacaagctgatcggctttctcacccagtcgatgcccgacctgaccaagaccgacaagatcccggttaccgcgccggacgacccggcgatcgtcgacaccgcccggcgcaacccggacaccggcgcccaattccacgtgctgcggcacaacgactcgacctcgatcgcggtcgaccggacccacatcgcgatcgacttcaacgcccgggccggcacctcgtacacctacgacgacgccgatcccgccctgcagtacaccggcgcctggtcgcatgtgtcgaaccagagctacaccggcggcgattaccacaactcggaatcgttctcgaacgtcgccggcgactcgctcgccgtcgatttcaccgggaccgcgatccgctggatcggctccaagaccaacaaccacgggtacgcggacgtctacgtcgacggcgcgaagcaggcgaccgtcgacacctcgggcagcgccgcccaggccgtgctctaccaggcggccgggctggcgaccggtccgcacaccctgaagatcgtggtgaccgggacacacgccgccggctcgaccgacgacttcgtgccggtcgacgcgatcgacctgccgccggccgtggccaccgccgaggccgtctacccgagggtgccgcagaagccgggcaccgcgatcaccctgaacggccgcgactcggacatcatcgtggccgacgccaagctgggcgacagccaactgcagtactcgacgtcggaactgctgaccgacgcccggatcggctcgcgcgacgtggccgtcctctacggtgacccggggacggacggcgagaccgtgctgcgcttcggcagcaagcccgccgtccaggtgacaggcggcccggtcgagcagacctgggacccggcgaccggcgacctgcggctcgactacacccactccggcctgacccgggtgtcgatcaccccggcctgggggcacccgctgcagctcctgctggccgacaaggcgacggccgagacgttctggcggcaggacaccgcggcggggccggtgctggtccgcggcagccacctgctgcgcaccgcgaccagcgcggccggtggccgggcactggcgctgaccggcgacaacgcgactgacccgaccatcgaggtcttcaccgcggcgaccgcgatccggtggaacggccgtccgctacggacccggtcggctgggcccggcagtttcaccgccgccatcccggccgccgcgcccgtcaccctgcccgccctgaccaactggaaacaccaggccgagtcgccggaggcgcagcccggcttcgacgactcgagctggcaggtggccgacaagaccagcacgttcagcgtgaccggccccggctcgctgccggtgctctacgccgacgactacggcttccacaccggcaacacctggtaccgaggccggttccgcacatcggccgggaccaccggggtgcatctcagctccgattcgggcggcggcgcgcaggccttctcggcctggctcaacggcgtctttctgggcagctcgacgagcggcagcggcgacttcaccttcccggccggcgccctgcggacgaccggcgacaacgtggtctcggtgctgaccgtgaacatggggcacgaggaggactacaactcgagcaacggcaacaaggcggcccgcggccttaccggggcctcgctgatcggcgcgccgacggcgccggtcacatggcgcctccagggtgtccggggcggggaacgcgagatcgacccggtccgcggcccgctctcgaccggcggcctctacggcgagcgcgccggctggtcgctccccggcttcgacgaccgcgcctggacgtcgacgaccctgccgaaccgcgacaccacacccggcgtctcctggtaccgcacgacggctgacctgcgcctgccggccggtcaggacacctcgctcgggctgaccgtgaccgacgacccgccgcaccgctaccgtgccgagctctacgtcaacggctggatgatcggcaactacgtcaactacctcgggccgcagcacagcttcccgatcccgaacggcatcctgcgtaccgacggccgcaactcgatcgcgatcgcggtctggaacctggacggctcgaccggcggcctgggcgcggtctcgctcaccgactacggcagctacgcctcgtcgctgcgggtggccgacgttaccagcccgtcctacgacccgcggaagtacgccctgccggccgccccggacgtccacgtcgatttgcaggttccggccagcgtccagcccggcacggcgttcaccgcgaccgcgacggtcaccggtccgcggtcggtctccgacgtcgtcccggccctcaccgcgccggccggctggacggtcagcgccccgagccccgccaggacccgtgcgctgcccgcgatcgtgacgtggcaggtccggccgcccaccggcgcccagccgtcgacggccgcgctgacggcgaccgtcgcctactccgagcgcggccgccgctcgaccgcgcgggatgagcggatcgtcggcgactactccccgccgcccgccggctcggtcgcggtcagcgacctgccgttgctctccgccaccaacggttggggaccggtcgagcggaaccagagcaacggcgagcagggcgccggtgacggcaaaccgatcaccatcgccggtcagacctacgccaagggtctcggtaccaacgcggtcagcgacgtcgccgtctacctgggcggcaaatgcacccggttcaccgcttcggtgggcgttgacgacgagcagaaaggcgccggcacggtcaccttcacggtggctgcggacggtaagaccctggcgaccactccggtcctgaagggcgggcaggcggccgcctcgatcgacgtggacgtcaccggggcgcaggcgctcgacctggtggtcggtgatggcggcgacgggaacggcaacgaccacggcgactgggcgacccccaccctcacctgtagttgagtccacggcggccggtttcgttcagctgccggggcggaaccggtcgggccggtccttctcgtagtcctcggccgggaagtcgctcgggctcgcgccggtcaggaacgcctcgcgcacgctctccgcatacgcctcgttgcgtgggcgccacggcgtagcgggatgtacatgacgttgccccagcccttctggtcctgcaccggcgcgacgctgtgaaccatgtcgcagtgccatcagaccgagtcgccggctcgcacatccgggatgccggacagcgccgccatgaggtcggggtaccgaccggtgcgggaaagcggtgacgatgcgagcgatcggatcgcggtcggatcagcacgatgatgggtcaagggctgtcatcggtagcttgtggccgtggcgtaaggctcgggcccggcgtcggtagacggtgccggcggcgccgatcgaggcggcgaggtagatgttgacggtcagagcgcctccataggcgaggatgggcgccttctggaggaaagcgacctccgccaggtagtgggcgaccaggccggcgaggaagagcgcacaggtggcgacgccgccgcggcgtacggccgccttctgctgcggtgaccaatacacccgcgcggcgcggccgcgcagcgcgccgaagagtgcgccgatgcccgccgagacgacgaggtatgcccatacggcgggggtgagggtgaaccaccacgcgttgaggatgatgatcagaattcccatgccgccgatgatcagcggcgcggtcggccggcccgcgatgctcttctccttgaactgacctcggaagatcagcaccagcacgagggtcggccatgacacggagatgatcagcgcggtcatcggcttgccgccgcggtgggtgcgaaaaggtggtgcaggacggcggtgtaggcgtcggcgtcgaggtgggcggatcgccgtgcgaggccgatggcgaatgcgtcgatggcgccgcgcagcgctctggcgaggtcgtcggtgccggccggcggaacgccggtttcggcgcgcgcagcctcgatcagcgccgaaagatcggcgagtatcgcctcgtcgacggcggcgcacaacgtgcggacggcggagactccgctggtgcgcaggatgatcagggcgaccgtggcctgccggcgggcggcgatccaggcgatgttggtcgcgacgtacgacctcagtgcgtcagcggcgcaggcctcttgcctcacgggactcatcgcgtcggccgcgtcgcggtagatcgagcgggtcaccgcgagcagcaactcctcgcgggacccgaagtggtaggcgatggtgcccttgctggcgccggtgcgtccggcgatcgctgcgaacgacgcggcctcgatgcccgactcggcgatcagatcgatggtcgcggcggtgagttgggcccgccgctgtcgctcggtgaagctggcggcgtccttcggttctcgcaccaggtcggtaaacgtttgcatggcggacaacgtagcacgatcgtctcaataattgaacggctgttcagaaattgattcgcatggtcaaccgatgcgccgccgccaggctggagccgacgtcgaacgggttccccatgcggtcggccagcgtggtccaggccgcgccgtactccatcaagccccgtctaactggttgaacggcaggttcagaccttggccttgaacgtgccgcggtaggcctgcggtgtcgtgctcaggcgctgcgtgaagtggtgccgcagcgtctgggcgctgccgaaacccgaccggtcggcgatcgcgtcgatgcccaggtcggtctcctccagcaggcggcgggcgagcaggacgcgctgggcggtgagccagtcgtgcggggtggcgccggtctcggcgcggaagcggcgggcgaacgtgcgcggggccatgtgcacgatgtcggccatcgtgtcgacggtgtgctcccggtccagggtctccagcagcagcgtcagcagcggctgcatggtctcgcagctgaccgtgggcatcggtgtctcgatgaactgcgcctggccgccgtcgcggtggggtgggacgaccatccggcgggcgatctgggcggcgaccgccgagccctgctcctcgcggatcaggtgcaggccgctgtcgatggctgcggccgtgccggcactggtcaggatggtgccgtcagcgacgtagaggacgtccgggtcgacctcggcccggggaaagcgggcggccagggcggccgtgtgcagccagtgggtggtgcagcggcggccgtcgagcaggccggcctcgccgagggtgaacgcgctggtgcagacgctcatcacccaggcgccgcgggcatgggcgcggcgcagcacgtcgaggatctcggccgggaccgggcgcaggtcgttgggggcgacggcgaccaggtcggcggtctcggcgggggcgaggtcgtgggtgggtgcgatggtgaacccggggcgggaccggaccggtttcgcgtcgacactgcacacggcgaagtcgtacgccgggaggccctccgcggagcggtcgtaaccgaacagttcacagaggacacccagttcgaagggtgccaccccggacatggtcagcaccgcgacactgcgcaacatgtccccacggtaaccggaggtggcaggattttgaagatgtatggcattcctgccactgtcccgggagtggttccgggacgacgctggaggcatggaaatcgcgatgctcgtcttcttcgtcctgctcctggccgcctcactggccgggctgaccgccgacagccgggacagcgccgactggaaacccaccaacgacggccgccgcgccgcatgacgcgcggcaggggagggccgccggaccgcaccggtccggcggcctgcggaaccggctgactcagcccaggatcgacttcggccggagggagaccaccggcggcagccgcttgccgtgcaccgcggcggccgcggccacccgggtcgccaccgtgcccgggtcgatcggctcggtgaacggctggtgctcggccgcgcagacggtgcccttggccggcagcgtgccgttcaacaggtaccggtcgatcgcggcggtggcgcagtcacccgtgccgtacgcggtgtgaccccagttgtcgctgctcagcagccgcgagttgggcagcgtccggctcaccgccaccgaggagtcgtagttggtcgccggatcccagaagctgccgacgatcagcaccggggctgcggtcctgtggttgaacgggccgcggtacgcatcctcgtcccgcacggtccacgtgtcgcgggcgcacggggtgtcgatgtagccccaggcccggccgaagtacggggcctgcttgtcacgggccgcggtcgccgccggccaggtcgcggcgttcttcgggtgggtgccgtcggtgcagatcaccgcggtgccggcttcgagaccgttgtcgtacgggaagtcgtagccgaccgatcgcgccgccttgatccgcttcagcagggtcgtgcgtgccgccgccacggccgccggcgagtcacccttgatcagggcggccacctgcgccgcggtgtccatcgcgctctccccggcgtacgtcgagtagagcccgccgagcacggcgctgacgaaatcggcgtacgtgatggtgtacgtccccgattcgtcggtgatcaccagcggcttcgccttgaggctggccgcgatcgccgcgaagttcttctccgggtcaccggccgcgaacgagcagtacttctccccggccctgtcgcagcgcttgaagatctctttcagggcgcggtacgcaccgtcggccgaatgcagacgggcatccaggatctggttgcccgcggcgccggccccgacccaggcccgcggatcgaggttgccgtcgatgacgagcgcccggaacctgtccgggaacaggttggcgtagtactcaccgagcgcggtgccgtagctgaagccgagataggtgagcttcctgtcgccgaccgcgcggcggatcacgtccatgtcgcgggccacctcggtggtggacaccgcgccggacagcggtttgccggtcgacgagcacgccttgcccagggcgcgggcgcccgcgacgtacgacgcctcctgcttccttcccagcgggaacgcgatgttgagctggtcgacgaccgcggtctggtccttgaccgtcttgaagcagcggatgttggcgctggcgccgatcccgcgcgggtcgacgccgacgatgtcgaacttctgcagcagctcgtcactgaggaagtccgatgcgccgagcgcgaagtcggtggccgagccgcccgggccgcccgggttgacgaacaggctgccgatcctgtgtttctggtccttggccttcacccgcaggacggcgatctcggtcttcgcgccctggggccggtcatagtcgagcggcagctgaacggtcgcgcactcggcgatcgcgtagcatttgtaccagccgagcttcggggtcggaaccgcgtcgaccccggtggccgccgcttgggcggggacggacacgctcgcggcgagagccacaccggcaattccggcggccgcgaaacgtgatctggagaggtgcatgaagagcccctttctcacgaggctcgcatcgtaggagaccgatgcacgcaccttccccgatcgtggtcagacgccggtcacggccagactgcgggtgatcaccgtgtcccgccactgcggggtgccgaacgcggcggggtccaccgtcgtacgccggccggtcagcacgaagcagaccgtgaccgcgctgaccaccccgaccagagcggacgcccagaccgccggctggccggtgcccaggccgtagaccagccaggccgaactggccgccgtggccagccggaatcgcgccgcggacagtcccgagatgtcctgggcgcggtcgcgcagcaaggccaccggctgcggcagcgcggacagcagcgacgagagcgcgagcaccgtgccgagcagcgcgccggcccgggccgcggtgacgtgcggcagcagcacgctcgacgccgctgcgcagatggcgaaaaaaaccggcccggcgatgctcgcggcaccccgcaggttcggccggccggccagcaacgcgatcagcacggcgaccccggcgatcaggttcagtgtgttcgacaccacctggatccggtccccgatcagcagcccgtaggtcagccagccggccggcatcgcgaccgagagcagtaccgcggccggggacagtccgccggtgcggcgccgaacgcacgagaggaagacctggggccaggcgatggacatggacagggcggccccgagaaggccgaaagcgtgcgcagacatgatccgattccgagtcgggggcgtggagtcaccctccgcatcgaccggcggtacgcatcgctgatcatcagcacccgaatggcaaccgttcgcaccccgggggtgaccggagcgggccggcatttggcacagtggactcatgctgaccgacgtggacctgcccgcgcccggcctgctgtggacccgctgggcggcactcagcgcagtgacgaccggaactgatcgcggcacgctgtggtcggtcgatccgtcgggcgcccgccacgacgacccggcgaccgggtgggcccgcttcgctctgctcgacggccgccgggcggtcctgtacggcgcgcatcacgaccaccacgcggcggtgtcggccgacccggcggcggatccgctgaccggggcgccggactggctgccatggtcggagctcacgtcactggcagaaagtgatcagctcgggttcgtgctctggcacgatcagggccggtggtcgcgggtccggtaccggcggccctacgaggacggcctggccgacgtcctgtggccgctgctcaccgaggcggatgccgtcgccgcgctgcacgcccggcacccgcgggccgtcggtcgcaccacggccgccgccctgctgcacgccgcgatccgcggcgaggtcgacgccggccacctcaccgcgctgctgggtgaggaagctgacattccggccgcgctcgccatcgcgggccgggccggcctcacccccggcaccaccccgccccggatcccgcccggccggcgcccggcgatgcgccgggtccggcacctcagccacggcgaacacgaccggctggtctgggcggcgatgcacgacgcggccgagctgcggcgcccggccccgccggacaccgaggagctcggtgaactggtccgctggctgcgggaacgcgcaccggccggggacggccgatgttcactgctggcctacgcggacgcgaccagcttcagctcgcagcccggcgaccatccgccggcgtcgcggccggccgaggagcgatacgcggctttccgccgcttgaccgagctggtccgggccctgcgccgcgccgagtccgacccgcgttacggccgctggctgttcgtccgggtggagacgaccgccgcgggccacgagatcgagcgctgctacgactcgtggccggcgtggtggcacgacgacggcgtctccggcccgtggcgcaccgacctgcaggaggagacggacgcccgacacgaccgctggcgcccgtcctggaccccgctgctggacccggagatcgcctaccgccccacctcctgaccggtcgccgcccagcggtcgcgggtgaggaaggccagccgggcccgcttgtgcccgaggtcgatctccggtcccggctcgaacccgtgccgccgcatccgggtcaccgccctggtgttgcgcacatccggctcgacgacgatgcgccggaccgccgggtcgcggaagcagaaccgcagcagcgccgggatcacgacgctggtcaggtgcgggaggtgccggtcgcccgggtcgaacatcaggtgcagaccgaagtcgccgggccgggtgtcgtagcacccgcccaccgggtcgtgctccggctggtaggtctggaagacgccgatcggcccctcgtcgatgagctggaggtaggcgtggtgggtgtcgaggctgtcgacgaaggcgtagatctcccggacctgctcgggggtgtggtccagcattccccagaaccggttgcggggccgggtcacccacgtgtggaccaggtcggcgtgcgccgccggatccagccggaccaggctgaactcgcccaggccggtgaggtgctcggtgaagacggtggtcatcggggctccagggtgaggcggtcccagtcggtgacgaggggcaccaggtcgccgttcgcccacagcggcaactggtcggagaaatgcggcgagccggggtcgtcgagcgcgccgaacgggacgacccaccggctgcgctgccggtcggcgaggtcccagacgtagcgggccaccgggccgcgcgtacaccggtcgctgaccccggggacgctggacgtgttcagcacgcagccggacgagccgcccagctcgacccggggcacggtgacgtccaggccggtcagcaccaccggggcgagcaggtgccgggcgccccagggaccgggcgccggtgtgtcggtgacggtcaggcccagaccgtcgaggacgccgtccaggtggtgcccgatccgggctcgcgggtcggtccacggcgtgaagagcgggtcgtacccggacggggcgaacagcggccgcaacgccggatgaccgtgcaggccgcgcgccgtctgcgaccgggaccacgcctggtggcccggcgacccggccggcagcgcggtgtccatgtggatctgctcggcggtggcgccccggtcgagcagctcacggatccgtgcggcccggccgggcgggcagaagtccacgccgtagggcgcggtgtccggccggcggtcgttggcgttgaccgccctcgccaccggggcccggaaacccggcgcccaagccggctgccaggtgtgccgcggctcccaggccggcaccggcacctgccggttgcggtcgtcgcggaccggcacccggcccgcggtcagctgcagcagcgtgcccgcggagtcggccaccagcacgctgttgaccggctccacccagccggcgaaggcgtccgccacctcgcccgcggtgcgcgcgcgcagcagcggcagcagggcgccgaagcccaggtcggacgacacccgggccggtgttcgcagggtgaggccgctgtcgatcagtgggccacgggcggtctcgatgacgtcgatcggcaccggctcggcgccccggacgtcgatcgtctcccgatgccgccgcgccggctcccagccgtccggcccccgggcctcgagcccggcgggggtctcccggaactcctcccggtacaggtcctggtagtcggccatcgcgttggtcaccgcccaggccacctccccggcgtgcccgaagtgctgcaccccgggcacgcccgggaaggtcagcccggccacgtcgaactcgtcgcaggccagccggatctgctggtagacgccgggcagctcgagcagccggtgcggatccccggcgatctgcccgggcgtcgcccaggcgttgctgcccgagccgcccggcggtccctcgaccgagaaccagccggtcgccgccgggccgagggtccgctcgacgtgctcccgccacagcttgtggggaaacgtcccgaacaggatgtgctgcacctggaagacaccgagcggcgaccacgggtcccagtcgcacccgccggcccgcacgccgtcggcataggcggtcaggaaccgccgggtctcgtccggcagcccggcgaaacaccggcgtgcggtgtcgtccaggcgggcacgccgggcgaaccggtcccacggcacctcgtccgggccggccacggcggccagtcggcccagcgaccgcagccgctcgacggtgatctgccggccccggtcggcggcggtcacccgcccctgcaggcaggccagttcgaggaccgaaccggcccgcaggtgcgggatcccgtacgcgtcgcggtagaccctcacccgaacaccgcgatcgggttctccagctcacccgcgaagatcagcgagccggcctggtcggtgaggtccaccatctgcagcgtgtcgcgcagctgcaaccggttcaggcaggaatgccggaacgtgggccgcagcaggttcagccggccggccagctccggatggtccttggcgtgtccccgcacgcagtccccggccagcgtccagaagtcgcgttcggccagcaccccgtcgaccgccaggatcccggccaggtgccgcaggaacccgtcgaagacgtcggtgaacagggcgagttccttgatctcgtcgctgacctcggcccggatccgctcgacccgcggtggcaacggccggtcgtcgagcaccgccacctcctcgccgatgtccttgaggaacacccggctcggcacgtgatcggccagcaccaggatcaggttctcgccgtggggcatgaaggcgagatcgtgggcgagcaggcagtgcacgatcggccgcaggtaggcccggaagtaggccgcgacccacgcggccggctcccggccggactcccggatcagcgcggtgaccagcgcgtcaccggcccggtcccggtgcagcaggctggccatggtggccagccgctcaccctcggcgagcagcggcaccggcgactcccgccagagggcggcgagcatcctggtgtacgcgccggccgtgcccgcccggtggtaggcgtcgccggtgtagccgatcgccgccacctcgcgcagcacaccgaagccgcatgcccgcagctccgggtcgcctccgacgacctgcgccacccactcgttgatcggcggcgtgtcccgcatgtacttcggcgagagcccgcgcaggaagcccatgttctgcaccgcgatcgcggtcttcacgtagtgccggtcgggccggtcgacgttgaagaaggtacggatcgactgctgcgcgcggtaccggtcggtgccctcgtcgagcggcacgatcgcccggcgcgccacgtccgcggcgaaggtcacggtcagcttgtgctcccactgccagggatggaccggcaggtagcggtagtcgtccggggccaagcccagcgagctcagataccgctcgtgccgctccagcccggcggccccgagctcggcgagatagtgcgcccgctcgtcgccgtcggtgacgaacagactggcatccttgcggacggcaacccagcgcaaccggaccggccggcccgcctcgggggcgtacgcctcgtggtcgcgcagcccgaagccgatccggccgttgttggccacgaagccgggatgcccctcggtcatcgccgtttcgatggtcgggaagtcggcgtgcaccagctgcgcggcggtctcccggcggtgggtcgccttccacgcggtgccggccagggtcgcggcgatctcctccagataggtgccgagcagtcgctccgggatgccgagcgtctcgcgcagcccgctgatgaagtcgagggcatcgagggggccgtccagcgagtccgggtcgaccacccagtgctccagcgcgaaccgccgcgcgcggaaggtcagcgcacccagccggtacgcgccgtcgccgagatcctccggcgcgagcagccgctcgtgactgaactcggcgatcgccttcgcgatcagccgccgatgcgcgtacgccatgacggccggccgcagatgcggcacgctcatctcgtacccggtgcgggtgcagaagctgaggcgggccaccttgtcgcgcagccggacctgtccctcctcgacgaaaccggcctccgcgttcttccgggcgatcgcctcgttgcggacgtccggctccacgaccacccggtcgatccgcgggtcggcgaagcagaagtcgagcaccgcgcgcagcaccgcggaggtcaccccggagcgcggccgggaggggggcgcgaccagcacgtgcatgccgatgtcaccggggcgcaccgggtagtggccggccagctcgctgtgcgccggctcgtacgtctcggccaggaacagcggggtgccgtcgtcgtcgagcccgagccacgcgtggtggtgcgggtcgtcccggatccgctgatactccgcgcggacccggtccgggccggcgccctgcagtccccagaaacgggaccgcgggtgggtcacccaccggtgcagcagctccaggtcacggtcgaggtcgagggggatcagccgcatgtcgtcaccagctgccgggtggggacgccgaactcctggaaggcgatccgctcctcgatcggatagacctcgcgcccggtcaggccgcgcaggatcaccgagttgcggtacggacccatgcccaggtcgggggcggtcagactgtgggtgtgctcctcggcgttctgcacgaagatctccttgccggtccggtcgaccgagtagtcgacggccacgtcgaagcggccgcgggcgtcccagttgatccggtcccggaccggttccaggaacgacggcacccggggcgtgtatccggtcgccagcaccaacccttcggtgttcgtggcgaacgaccggtcctgctcccggtggtgcaggccgagcgtgtaccggccggccgccgcgtcccaggtgacgtcggtcagctcgacaccggtgagcaggctcgtcgggaccgggccggtgagactcccggcgtacaacctctcgtggatcgcgtcgaccaggtcggcgctgattcccttgtggaggtgacgctgctcgcgggccagccggtcgcgggtcgccatcggcaggccgtggtggtaccggatgtactccggtgaggtcatctccagcgtgagcttggtgtactccatcgggaagaaccgcggcgagcgggtgacccagctcaggtggtatccgtaggtgtcgatcccggcgagcaggtcgtggtagatctcggcggcgctctgcccgctgccgaccacggtgatcgaccccagggtgcgcagccggtcccggtgggcgagatagtcggcgctgtgcacgtgcggcacccggcccgcgacggccgggacgtgcggggcggtgccgacgcccagcaccagccggcgcgcccggaacgtctccgcggcggtgtgcaccaggtaggcctcaccgtcgtgggtgacggtgtccacccgggcgttccaccggatcgcgggcagctgggcggcgacccaccggcagtacgcgttgtactcggcccgcagcgggaagaagttctcccggatgtagaacgggtacagccggcccacctgcttgaggtagttgaggaagctgaaccgggacgtcgggtcggccatcgtgaccaggtcggccaggaacgggacctggatggtgacgccctcgatcatcaggcccgggtgccagtcgaacccgggccgggcgtccaggaagacgccgtccagatccggcacgttctcggtgagcgccgcgagacccaggttgaacgggccgacgccgacggcggcgaagtcgtaggtgcgcatcaggccggcaccgccgggccgtgcagcacggcggccgcctcgatcaggtccagcgtgtcgtgcaggtgcccggccgtggtggcggggttgagcacggtgaacttcagccagtgatggccgtcgacggtggtcccggcgacgatcgcggcgccgtcgtggaacagccgctgccgcagccggggcatcagctcgtcgcattcggccacgctcatcccggccgggcggaagcggaacagcagcgtgctcagcgtcggtgcggccagcgtctcgaagccggaccgggtccgcatcgccgcgaagatctcgtgcgtgcggtcgaccacggtgtcgaacatgtcgccgatccggtcggcaccgatggtccgcagcgtcatccacagcttcagcgcgtcgaagcgccgggtcgtctgcaggctcttgtccacctggttggggacggtcgcggcgcgggggttgaggtagtcggcgtgcaccgcgatccgggacagcgactcaccccggcgcaccaccagggcgctgcagctgaccggctggaagaagctcttgtggaagtcgacggtgaccgagtcggcccgctcgacgccgtccagcaggtgccggcggcggcgcgagacgagcagaccgcagccgtacgcggcgtcgacgtgcaaccagatccgctggtgcccgcagaccgcggcgatcgccgggagcgggtcgatgcgccccaggtccgtggtgccggcggtggcgaccacggccatcgggatcccgcccgcacggcggacgtcgtcgatcgccacggccagcgcggccgcgtccatccgcccgtccccgtcggtcgcgacaccgaccaccgcgtcgccggccaggccgaggatgccggccgacttgatcacactgaagtggctctgggcggtcgcgaagatccgcagccgggggagcgcctccgcccggtcccgccgctccagcgcgtgctcccgggccagcagcagaccctgcagattggactgggtgcccccgctggtgaagacaccgtccgcgtcgggcccgaaaccgatccggccggcggtccagtccaccaggcggcgctcgatcagcgtggccgtggtgctctgatcccaggtgtccaccgaggagttcaccgccgagaggagcacctcggcgctgagtgccgggatgaccaccgggcagttcaggtgcgcgacgtaggtcggctcgtggaaccagacggcgttgtccagatagagccgggcaacctcgtgcagggccgccccggtgtcaccgagcggccgatccagatcgaccgcgtcgacctgctcacgcagctcggccacggtcgccccggcatacggctggcgcaccgccttcacccgatcggccagcagggccgaggcgtgccacaccgccgacgtgtacgcgtcgagggtggaccccgagaacagatgcggcaatacgggctccaacgcggcctcctataaggttatcctaacctaacttggaggaggctagcctgccgccgtcggatggcaaagcccgcccccgggaccggcggtcagcacgtgatccggaacggcgcatcgacagggcggcttgccggcgtcgggcgaatgccgccaccgggcgggcgacgagagctcggcgcggtcggcgcggaacccggtccgcgcggcgagatccgccggcccgcctggtccaccgagatcgtgcgcgaccactactgagccgtgggcggtgccgcgatccggcgccgctgcacggttcagtcctcgatcgtccggcccggccgggcggccgggccgttgctgtcagcggaggcgggggagttcctcctgggccgcggacagccagtccagggcgtattccagatcggccgcggcggcccggcgcgggtagtggcggtcggcacgcgcggccgccgcgcaggattcgatggcgcggcggaggcgggcgtacaggaaagggtcgtcgatcggcgcgggtgggtcggcggcccggcggtggcggcggacctggaggtggcggaggccggcgcgcagcgcgtaggccgcccagaccccggcgaccgcgatcgcggccaacggcagcgggcgggtcgcatgcgggatcaggagcaccaggggcagtacgacgagggcgacggcggccagcgcgaccgggacggtgacgctgctgatcgccgacggctggacgcggtagcgggcggcggcgttgcggacctcgtggcgtacgtggccgaggcgggcgaaaccgacccggtcggggcggtcggcggtccagtcgcggcactgggcgtcgatgatcgcggtggtgagttcgcggtcgatgcggcggtagcgcggggacacgccgccggtgaacggatcatcccggacgttcatgacaactcccgcgaggcgacggcgacgaaagagcgcggggcagcggcggcaggtgggcatgctgccgcggccacaaaggcaagaaaggcaaacaaggcaaacaagtccgaaagggcggacaaggccgatgaggtggtcatggccagtccttgccggcgtcgtcgaggtaacgctccaggcagtcgatggcctggcacagcagcaggtccgcgtcggccagccgggccagcaccggatcggtggtcatcgcgcggtgcagggccggggtgtgccagttggcgcggccggcgtggcgcagaccggccgacaccagctgcacccgggcccgttccagggcgaacgggactgccaccagcccggaccccggcgagtccgggagtggcggcaggtcggggggtacgccgcggcggcgcaggacggtggccaggtgcagggcggcggccagcaccagggcggagaacatggccacggcggccgggggtgccttcgtcgcggtggcgagcgcggcgcacagggtgaccaccacggcggtgacggcagtgttcaccagcatcgaggtcagggcggagcggcgggggagcagggcggccaggacggcgtcggcggcggcgagccggccgcaggcggagcggatccagacctgttccacgtcgccgttcccggtgagttcggcgaagccgtcggcgatcagcgcacgcacggcgccgacttcggcgggcagcgcgcgaaccggcgacatactcagcagaatcgcaccgatggggcggtggtgaactgtcaggtttctgcgtcgggccggcgccacccggcggcggggcgcgcaatggtcgaccgttgggctcatgtccacggggtggccgccgatcgtcccgccgtgcgcagacagtggctgaagctgccggccgggaccgtggcacggacccgggtcgccgccgtggcagtcggcggcatcggcatcgtgatgcagctgggtcagctgggcaacgccatgcggccggtcgcgttcagccgtgtctccggcgcgtcgatcgtcgccctggtgctcctgctggtggtcatgcaccggcggcagcgcagcggatggtggagcgtcccggttatcccggtgctgatcgcggtgggcgcggccggtctgcgggacccgctggccgcaaccgcgctgtcgctggccacgctgatcacctgcacgctctacgacacgccgcgccggtggctcgcccgggtggtggcggcgctggtggccctgccggccgcggtggccatctccccggacgtgctgccccaggcgccttcctggcacgcgccgtcggtgctcgccctgctgccgcagatcctgctgatgggcctgctgacccgggcgttccatctggcgctgcagcgccaggagcgggccgccgagcgggacgccctgctcacccgagccgggcagaagctgctcgcggtcaccgacaaccaggggatccaccgggtcggcgagcggaccgcgctgcggctggccgacatgcatcccggggtggtgctggtgatcgtggtgcgcgacgccgacgggctgttcgtggagttctgcgccggcgtcccgtccggaccggtcgggacccggctgtcgggggcggcgcccgatccggcggagctgaccacgctgctgcccggttacggtcactggcacacggactcgctgggcggcgacccggccaccgcgccggtgctgatgatggtcggcggccgcagggcggtcccggtggaggtgctggacgccttccggagcctgtcctaccaggtgacgttggccggcgaggcgcaccaggcgcgggtcgagctggagtaccgggcgaaccacgaccagctgaccggcctgccgacccgggcgaagttccgggcggcggcggaggcggcgaccggcggggtggcgctgctcaacatcgacctggacgggttcaagcgggtcaacgacgagcacgggcacgcggccggggacgagttgctggtcgcggtggccgggcggatcgccacggcggcgggccggcacggggtcgcggcccggttcggcggcgacgagttcgccctgctgctgaccggcgtcgaggatgccgggcaggccgaggcggcggccgggcggttgtgcgcggcgctggccgagccggtgcggctgggtgcggcgacggtccgggtcggcgccagcatcggggtcgcgctggccgagcccggtgtcggcgtcaccgacctgctgcgccgcgccgacctggcgatgtacacggcgaagcacggcggcaagaaccgggtggtccgctacggcgtggagtgtccggcggcggtctgagcgagccaggcggcggcggcctcggcggtgggcacggtcgcggccgccggcagcggcggacggtcgatcatcagcaccggtacgccgagctcccgcgccgccacgagcttcgcgtccgatccgccgctgtccttggtcaccagcacgtcgatccggtgccgcaggagcaggtcccgctcgcccgccacggtgaacggcccccggtcgagcagcacttcgaggcgccggggcagcggcggctccggcggttccaccgatcgggccaggaaccagcagtcgtcgcgggccgcgaacgccccgatcgtctgccggccggtggtcaggaagacccggccgccggtcagacgcgcgacggctgcttccagggacgcgacgcggtgccacgcgtcgcccggcgtcgcggtccagccgggcctccgcacgacgagcagcggtacgccggtggccgcggccgccgagcccgcgttgccgctgatccccgccgcgaacgggtgcgtggcgtcgaccagcacgtcgatccgctgctcgaccaggtaccgggccagcccgtcggccccgccgaacccgccgatccgcacgtccccggccgggcgcagcggcgcgctggtccgcccggccagtgaggtggtcacctcgtggtcatcggcggtcagcccggcgagccggcgggcctcggtcgtcccgccgagcagcaggatcctcacggccggcagcggtcggccgagtacaggtggctgtccgggaactgggccgcggtcagcgccgcaccgaccacgatcaccgcggtgcgcttgatcccggcctcctcgaccttggccgcgatgtcggcgagggtgccgcggacgaccagttcgtccggccggctggcccgggccaccaccgcgaccgggcagtccgcgccgtagttgccgaccagttcggcgaccaccgcgccgatccgctgcacggccaggtgcagcaccatggtggcccggctcgccccgagggtggccaggtcttcgccgggtggcatcgcggtggcccgctccgcggtgcgggtcaggatcaccgtctgcgccaccgccggcacggtgaactcgcggcccagggtggcggcggccgcggcgaacgccggcacgcccggggtcacgtcgtacggcacgccggccgcgtccaggcggcgcatctgctcggcgaccgcgctgaacaccgacgggtcgccggagtgcaggcgggccacgtcccggccgtcggtgtgggcggccaccatctcggcgacgatctcgtcgagggtgaggttcgcggtgtcgaccaggcgcgcgccgggcggggcggcgtcgaggagctcgacgggcaccaggctacccgcgtacaggatgatcggactctgcctcaggagccgatgtccgcgcagcgtgatgaggtcggcggcgccgggaccggcgccgatgaaatgtacggtcaacgggttaccgcccagatcgtcaccggcatggaggtgcgccagccggtgaagccaccgaccggcgagccgcgctgcaccgtcaggcgggtcagcgcgccgcccagtctcgcgtatgccgcggcgaccaccgcctccgactcgacggtgaccgcgttggccaccagccggccgcccgggcgcagcgccgcgagacagctgtcgagcacgccgtccctggtcaggccgccaccgatgaagatcgtgtcgggccgggggagaccgtcgagggcgtccggggcgcggccgtgcaccaccgtcaggccggggacgccgagcctggcggcgttcgcggtgatcgtcgtcacccgctcggcggacgactcgatcgcgatcgccgcgcaggccggatgggcgcgcagccactcgatgccgatgctgccggagccggcaccgacgtcccagagcagcgcgccgggcaccggggcgagggcggccagcgtcaccgcccgcacctcccgcttggtcagttgcccatcgccgtcgtacgcgtcgtcgggcaacccggtgacgaccggaagcggcggcccgtcgccgcactcgaccgcgatcacgttcagcgggtcgccgggtggcagcgcccagtcgccggccgcgccggtgcacacccgctcccgcggcccgccgagctgctccaggacggtgagctgcgcccggggatagccgcgcgcggtcagataggcggcgaccgcggccggggtgtccgcgccggccgacaggaccagcaggcggcggcccgggttcagcacccggccgacgctcgccaccggggcggtgaccaggctgaccacgtcggtgcgggccaggtcccagccgagccgggcggcggccagcgacaccgacgacgggtgcggcaggacccgcagccgctcggggccgagcagcgtcgccagggtggcgccgatcccgtggaacatcgggtcgccgctggccagcacacagatccggcggccgtggtgggccgcgaacaggtcgggcagcccgggcagcatcggggacggccagggcacccgctcggccccgaccgaatccgggagcagggccagctgacgggggctcccgaagatcacttcggccgcggcgagcgaggctgacggcgtaccgccgtagtccgggaaaccgcccgcgccgatcccgacgaccgtgaccaccggagggttttccgcacgcatccgcagaacctatcccgtcccggattccggaattttccggtccgtggttgagccatccggcgaccgcgtgcgtacgcattcgtgacggcgtcgaccgagaccggcccgtcacgtcggccgcaggggtggcggacgccgcgggactagtggtgagcgggtgaggacgatggccataccggccttccaggaccagcgtcagctgccggaggacgacgacggctacttcgccggcctgcgctcggacactgacgaccggccgtcctggaacgggccgtcgcatgccgggccgacctgggacgccatgccggaatggccggcggcggcgccgtcgcagccggccgatccctaccggcgcggcgacatcctggtcgagtcgaacacctcgccgaccggctggaaggccggcaccggcgtgccggtgccggaggaccggccgccggccgaggcgacctcgggcaaccggctgttcaccgtgatgctgttcttctccgggctggccaccagcgtctcgctgtggctgttcgacacccacgccggcgcggtgcacgacaccgccagcatgatgctggccaccggccggatcaccgggctgatcggcggctacctgctcttcatccagctgctgatgatgagccgggtgtcctggctggaggagtgggtcgggtcccgcgacctgctccgctggcaccgctggctgggcacgtcgatgctggtcgcggtgctcgcgcacatcgtcaccatcgtctacgcgtacgccctgcaggccgacaccggcgtggtggaccaggcgtggagcgtgatcaccacgttccccgagatgatcagcgccacggtggccaccggtctgctcgtgctgctctccttcacctcgatccgctggttgcggacccacctgccgtacgagctgtggcacctgatccacctcaccggctacctggtgctgctgctcggctacggccaccaggtcgccaccggcgcggacctgagcgggcggtacgcgtcgtacttctggcccggcctgggcgccctggtgatcgccgcgctggtctggggccggatcgtcgaaccggtctggctcaacgcccggcaccggttcagcgtcgccgaggtggtcgccgagggtgccaacacgttctccatctacatcgccgcgaagaacctggacaggctgcccgcacaggccggccagttcatgcgctggcggttcctgaacgccaacggctggtggcagtcgcacccgttctcgctgtccgccgcccccaaccgggagtggctgcggctgacggtgacggtggccggcgggcacaccgccaagctcggcgcgctgcggcccggcaccccggtctgggcggagggaccgttcgggacgttcacggcccagcggcgtacgcgtcgccgggccctgctgatcgccggcggctccggcatcgcgccgatccgggcgctgctggaggacatgccgccggacaccatcgtgatctaccgggccagccgcccggacgagctggtcttccgggccgagctggaggagctggccgagcagcgggacgcctgggtgcgctacatcgtcggctcccgcaccgacccggggccgcagcggctgttcaccgaggccggcctgcgcggcctggtgcccgacgtgaaccggcgcgacgtgtacctgtgcgggccgcccgggctggtcaacgccgcggtcgccacccttcgccagctcgaggtgccggacagccagctgcacctcgaccccttcgagttctgatccttttcgggagaatcgtcatgcgtcgtagcaccgcagcagccgtcggcaccctgaccggtgcggccctgatcctcggggtgcgcctgagcgtgcagccgccggcggccccggcggccgaggccgcgcccgtcgcggatcagcagaccacggagccggccgcggggaagaagccggcttcttcggcgccgtcgaagaagaaggacgagaagccggccgacaaagcggccgacaagccggccgcgtcggggctgaaggacggcacctacaagggccgggccgtgcagaaccagtacggcaccgtgcaggtcaccatcaaggtgaccggcggcaaggtgaccgacgcgaccgcgacctaccccaagaacgggtacagcggcacgatcaacccgaacgcggtcaccaagctcggccaggagaccctcaaggcgcagagcgccaaggtcgacacggtctccggcgcgaccttcaccagcggctcgtacaagacgtcactgcaggcggcgctcgacgcggcggcgtaggttgcgggggtgcggcacgtcgaacacgtcatgggtacggtcgtcagcatcgacctcgccgacgacctccccgagtcccggctgcgggagctgatcgcgtccacctgcgcctggctgcacgaggtcgacgcgcggttcagcacgtactcccacgacagcgaggtcagccggctgcggcggcgggagatccggcccgaggactgctcggccgacctgcggctcgtcctcgaccgctgcgccgacctgtggcgggagaccgacggctacttcgacgcgtacgcgcgcggcccgctcgacccgtccggatacgtcaaaggctggtcggtcgaggtcgcctcggcccggctcgcggcggccggctccacccggcaccacctcaacgccggcggcgacatccggatgcgcggcgccggaccgggcggcggcccctggcgggtcggtgtccggcacccgtgggaggccgacaagctcgcctgggtgctcggcgtgcgggacggtgcggtggccacctccggcacctacgagcgcggcgcgcacatctggaacccgcgcaccggccgggccgcggccgggctgcgggcggtcaccgtgaccgggcccgatctggcggtcgccgacgcgtacgcgaccgccgccctcgccatgggtgaacccggcctcgcctggctggccgaacgggtcgccgacggctacgaatcggcggcggtcaccgaggacggccgggccttcacctcacccggcctgccggtcatcgactagaaatcggcgaacatgtacggcgtacggcgggggaagagcgcgtccagccgcgtgatcgcgtcccggtccagatcacccaggccgcgggtgaccacctccaccgggtccagcacgccgtagaccagcgcgctcaggcccgcgacggtcagcgtggccgccggggtaccgcccggccgcacggtcagccgcccgtcgtcggcgcccagccgccacaccccgccgatcagcggatccccgggcaccgccacggtgatcccgcccacgcccacctcgaccccggcgagcgccggcagatccagcacccggaccatcggggcgttcctgaccgggttctgcacggtcgccgcggtggtcacggtcatgtcggtgccccacagctcgggcagctcgtccgcgccgagcagcacctccacccgggacacctgatcgacatgccgggccaggaactgcagcagcagcgcgcggcccagcggaccggtgctgaacagattcgaccccagcaggtcaccaccgtgcgcgtcgatccggtagcgcagcccgccgaccgtctccccgtccacccgggccagggcgatccacaccgggtcctcgcgcagcaactgcgaacgggtctcgtcgaagaccgcgaagccgtgccggtcggcgaggagacggtgggtgagaacgtcgtactccgcgaagccgtcccgccccggcagacgctggaccgaaccgggaagctcgcgccgcagcaggtcggagagcccctccggggcgaaccgcgccacccggacccggggaatcccgacataaccgaaccgggcgtagaagctcggccggaacgggtacagcgcgctcaccgcgcagccctgctcccgcgactgcgccagcagccgatccagcagctgccgcaccagcccaccgcgccgcgcctccggccgcgaggtcaccgacgcgaccccggccatgtcgtgcaccaccccgcgcacgttctgccgcatcgggtagccggccgcgcaggccagcgtctccccacccgcctcggccaccagcatcgtggtggtcgcgaagtaccgctggttggcccggtgcttcgtctcgtcctccggcgtgcccggggacggcaaccaggcgtaggactgcagcgggaacatcgtcgcggtccgctcgtcagcggtgatctgccggatctgcatcccgtcatccaaccggtttcgccagctcacaacacgccggggcaccccggtttggagaagggcctggtgaccggctatggttttcgagtcgccggggagaccgggcggcaacgcggacgtagcgcagctggtagcgcatcaccttgccaaggtgagggtcgcgggttcgaatcccgtcgtccgctcggagaggccttcacacgtacacgtgcgggttctgctcggtggagtggccgagaggcgaggcaacggcctgcaaagccgtgtacacgggttcaaatcccgtctccacctctctatggtgggtgtggttttaccgcgctagctagctagctgcggactagttgttgcagcttgcggccttcttcttgcgtcaaccgccgtgccctgaccggctcggccaacccgctacctcactctccacgacgaatgtcaccgccgttgagagtgaggcgtcgccagtagttaccggtggaagtgatccggcgtgtcatcgacccggtgaacgttcgtggtcaacgcactagccggagtatcgttccacttccatcaccgcggaacagcgcccgccgggccgcgttgcctgttcaagatcttcaggtgacgcgctcggccggaggtggcggccgttccggaattcggtccgcaaccctggttccgtattggcggtacggctgcgacttccggaacggcgcgacggagcaggtggtggtcagctggtggcggccgtcgggcggaggtaggcgtacacggtctcgcggctgatgccgtactcacgggccaggtcggctttgcgctcgccggcggcgacgcgttcgcggagacggtcggcttgttcggtggttagcgccggcttgcggccggtgtacacgccacgctgcttggctgcggcgatgccctcgcgctggcgttcgaggatgagggcgcgttcgaactcggcgaaggcgcccatcacgctgagcagcaggttggccatgggggagtcctcgccggtgaagacgaggttctccttgacgaactcgacccgtacgccttgccggtcagggtgcggacgaggcggcggaggtcgtcgaggttgcgggcgaggcggtccatcgagtggaccaggacggtgtcgccgtcgcggacgtaggcgatcagttcgtcgagagccggccgggtggtgtccttgccggacgccttgtcggtgaagacccgctccacctcgatcccgtcgagctggcggacggtgttctggtcgacggtgctgacccggatgtagccgacgcgcttcttcttcgccttcctgaccacaacctgtcaggttgaactctgtgaggccaccggacaggcgtcaagaaacgccacaacggaccctattctgacgtgctttggtgctgatggggtatgcggtgttggggcataccccaagtgggcgttcctgctgtgcctgctgcgcaccaccgggcggtgcttcgactgggtttcgctggcctggcctggcctcggacgcaaagggtgctgtgtcgcccaactatctaggcagtctagctagactccctagatagttttgggtacggtgttagttatgccggtcaattcattgcccgctgagtggctgcgcgggacgctcagcctgtgtgtgctcggcctcctgtcggagggggactcgtacgggtatgcgatcacggaacgactggaggaggccgggcttggtgtgatcaagggaggcactctctatcccctgctggctcgacttgagtcgcaacagctggtggagccggtctggaggagtggtcaggggccggaccgtaagtatctgcatctcaccgacgctggacgttcggaacttaccgaccttcgatcacggtggaagcggttcgcgtccaccgttgactcgctggctcacggcaggacgaaggatgatcatggtggctaacacgactgattcagcatggatcaatgacttcaagctccagctcgccagccagaagatgccgtcagccgccatcagtagggcggtcgaggatgtcgattcgcactgtgtcgacagcggacaaagtccccgtgaggcgttcggtgagccgagggagtacgcggcggtcctggccagtgagatgagccctgcacccccggatcggggatacgcccgtcgccgggtggcgtcgctgctgccactcacgctggggctcgcagcgggggtttcctgggcgttcacggatgagtccacgtcatcgatcagcctgggacagatcctgttcgtggtcgtcattgttcccgcctgggttttcgtgacggcgccattggcaccagctcgttcccgtgacgcacggactccggaacgtcgtgcgtttgacgaacggggatggcggggcctgtgggcctctttggggctggccgcagcaggtgtcgcgctgtggatcacgcttgaccagacggtgttccatctgccgacgtgggtagtcggcgtggtagccgcagtcctgctcgtatgcggcttggtcgccggccggtttgcctcagtcaagccgggacaatgaggtagtgcgccctgccgaggctgcacaccagcctcggcaggacgcactcggttccgcttacttgatcagcacacgtattccttgatcaggttgccgatcgcggcgacggagatcccgcccgcgatgacggcctgccacgagctaacccgcatggtgatgccggcgatggcgaccatcgcgctttccgacagcccggtgatcatgaaggcgatgaaggcgacgccgacggctgcgagggcggcgaccgcagccgcgatcttggccttgcaccacacgctggtgccgcccgccatcggcccgacgaccgacccggtcctggccgccgacttgctgattgccgacttgccgtcgagaacgatgtcccggtcgctcaccgagatggtgtgcttcgagccgtctgcggcagtgaacgaagcggagcccgtggactccagggatttgaaggtctcgtcgtagaccttctgcgccgccgcattcgtgctggcgtacgtgtcggccttgaccgcgctggccgagctgctgccaagcaccccggtggacgctgaggctccggtggagaaggtcagaaccatcgctgcggcggtcaccatgccggtgaggactttcaggccttgacgaaacacttagactccacttaatagattatcttcgatgtctaacaatgcattgcaccgcagcagagcgccgataacggcgctgtagtggtgcggattctgtggcttactcttcttggtgggtaagccacgcccggagcgcagttttctaagcgcggaagagggggacggcgtgtacgtcaatatccgtcttagggattaggcttgaaccgcgcctgcggatccgggattcgggcctcgggaattggtggtgctgtgccgagggctgcccctgctgaaggggccgttaatttcttgagccgtgaatcaatcactcacatgacggggaagtagccgctccggctggacgtcgattcgttccaatgcgtagcggcgacttgatcacatcgttcctcccctcttccgaggtgcctcgaccaacgcgttggtggtctctcgccagaatgaacgcggtcgatgcccagatttactgcatcggtctcaggaaattttttcccggccccctctcgcacgtcttggccgtggtgtcccgacgccttgaccagcaacgctcagctcagtacctggcgcaacctcttcagcgctcgtacggtctggctggtcactgtgccgggtgtgcacccgagagctcgagcggtctgttccacgctgaggtcacggaagaagcgcatggagaggaccgtccgttgacgctcaccgagctggctcatcgcagctgccagcacggttcggtcctccaccgcgtcctgggcggcaggttgatagccggcctcgatgatcactgaggttaagagctcgtgacgccagcgcgagcgccggcgctcggtcagaagactggtcaccaccacctgccgggcgtatgccctcaggccgccttgcttgcacagccgaggccaaagacgatagatcttccatagggccgtctggacgaggtcgtcagcttcgtgccaatccccgcacataccgtaggcctcgtggcgcaaccactgccggaccgcttctgcaaatgcttcgaagcaggcgtcgtcggcctcaaccgccatcccccgttcccccgtttccccgtgctagcgtcgttcggtcatatggcatgccgctgggaacgacgtcgtgctaccgaagatgaaccgatgccggacaatcaagatccacatcagcgcgcaaaactgtcttcaccctccgttcatcactgcgtgacaattgctaacggttaagaggaagttccatacctcaatgtctatgttgcgaactttttcatgcatagcacgacctggcaaggccgatataagcccggcagcggcaaaccgatctgatggcgccactgccgccatcagaaccggctccagtcacctgatttgcaaccctgaggacttccgatctgcgatcctccggggtcatcgaagaaagccagatgacgcctcgcgatgggcaggacgggggtaggcggcgccgttcgcggcgtccctgttcagcccgcgccggtcagtgttcttaccgctgcctgccgaagaaggcacttcgcgcagctggccgcggtgagcgcggcttgctggcgggccctgctcgcggccgtagccgacgagcacgccggcgaggggccaggactcccggccgcctgtccgcccgcgccgccgccgtcgcgctgactctgctttcggtccagcggaccgggccagagcgtcgcttaacctcccacgccgcagtggtcagccactgcgtcaactgctttacgtcgaccaccgagcacttgtggaagcccggctagcagaacctcgccggccggcagcggattctcggcaacgaccatcttcgacaccctggccccgtagcacctcgaaatggctcgccgcaccaggaatgtctaaatggggtgtaccccaaatcacataccccgccgcgaccgggctacgtcgtgctcttccacgcgcgtagcgcttcacccatggccactgtttccgggtgctgctcgccgagcacccgcaccgtatcgacgagcacctgctcctgcagggcgatggcgtcggcggtatgccccgcctgccgatacgaggcggcgaggttgccccgggcgatcagggtgtccgggtgctgctcgccgagcacccgcaccgtatcgacgagcacctgctcctccaggccgatggcgtcggcggtacgccccgcctgccgatacgaggcggcaaggttgccccgggcgatcagggtgtccgggtgctgctcgccgagcacccgcaccgtatcgacgagcacctgctcctccaggccgatggcgtcggcggtatgccccgcctgccgatacgaggcggcgaggttgccccgggcgcgcagggtgcccgggtgctgctcgccgagcacccgcaccgtatcgacgagcacctgctcctccagggcgatggcgtcggcggtacgccccgccagccgatacgaggcggcgaggctggcccgggccgtgagggtgtccgggtgatcgtcgccgagcagtcgggtggcttggtcggtcatgtgctgccagtaggcgacggcggtggtgtgcaggccggcgttgagcagactgattccggcccggtacagcagtgtgggcccgtcggggtgccagagcaggtcaccggcgtgctcggccaaggtggtggtgttgctgcgtaaggcggtgatcaggtcggtggtgccgtggtcgatgtcgggccataccgcgcgcagggcgtccgcggccgcctgggcgacggggctggggtcggtgagggtttcacgggtggcgcgggcggtctgggcgtggatgcgcacgctgcgggcggtgtcggcgctggtgtgggcgatcagcccgtagcggtccagcagccgtagcacctgccgggcctgctcggcggtgaccgggacgccggcaccggtgctgcggtgcgaggccaggtagtcggtgaccgcagtggtcgtccacagggtgtcggggtgcccggccgggtcgagcagggcagccaacccgagggcggggcgggccaacccgacgggttcgcgctggtcggcggcgtctacaccgagcagcagggtcacggccacggggatgccgtagtcgtcgctgtcagcctcggccggcatcagcttcgccagcggcgcggcgctggtgtagcggtcgaggtaggcggcgcagctttcctcttggtcgatcatgtaggcggcggcgtgggacagagccaggggcagatggcccagggccatcccgagctggtgggccgtcgactcgtcgaacaggtgcaggcacccgccgtcggtcagccgctgggccaggtaggcgacggactcggtcgggctgtacacgtcgacgtcgatgcggtgccggcccccaccggtcaagacggcgtctcggcggcgggtcgtggccagcgtccacccggtacgcccgtgcggcggccaccatcccctcacctgtgccgggtcggtgatgtcgtccagcaccaccagccaggcccggtcggtggtcctcagccaggacaggaacgctttcgcgtccgtggccgggtcggtcccatcagcgccgggcgccgcgactttggtcgcggcggcggcgtaggtggtgacgatctggtcggtgctggcggcgttgacccacaccaccacatccgtacgttccgcgatggcttgccgggcgaaccaggccgcgagctgcgacttaccgaccccgccacctccggccagcacctgcgtcccccgacctaacgcctgttgctggtcgggttgggtgagcacgacgtcgcggccggcccggtgcgccgcctccacccgctgacgcagccccggacggggttggaacgctgacgcctgcacgggcagtgaagaaacctcgatgatcggccacaccgggtccggtcgcgacggcgcaggccgcaggtcgatgtagataccggtattggcgatgccgccccggtcggcacaggcgtcccccgagccgaccacccgacctccgccgagaccttcaccgcccgcagcggtggtcacggccgcggcgagcggtacacgccggtgttggccaccgagccgtgcccctccgcgcgcgcctcccccgaccgggtcacctgcgccgcccggtcaccggccgcgccggcgataccggtgctggcgtgccctccggcggtcgcggtggcagcaccgctgtcggtgacccggtccgcgtccaccaccgcttccagcaacgccgcggccgccgcgaggatctgctcatcgtcgaccgcgcccgagacagtcaactcctgccccagccgcgcctgccacacctgcggatccgtctcgtccgcgtccaacgccgcgcgtgcctcaccccgcacccacggcttcaacatcgccttgaacccggcatacgcgtcccgcaccaccgccgacgcggtgtccttcacccccgcgctcgctccagcggccaacgcacccacgatcagctcaaggttcgacaccagcgcctccctattcacggctgaagcaaaccccgattgtcaccatcgacaccagttgatcacagcgcgaaacgcgtgtcccgcggacatcaacgccgcttcacccagacgagactcctgcgcgcacccgcagcggcgaggcacagtcccggtgcacctatctcaccctcgtggcgccctggtcaggtggtggtcggagggcgtcgcaaggttgcgtacgccgccacggtgatcgccatgggggtaccgatggcggggtataccgcagattgacaatcgacgtccgttctaagcgcttatacgcgagaagttctaggtttatgtcgcaaacatgaggttctgatctgccagaccgtgttgcaatcgcttgggcgtgtttgcgcctcctgtcgttgatgagaggaaggttctatgaagaaggctcttggtcgtctggccgcaactgcgggggcattggccctcacccttgctgccccagcgtcgccagcgcgtgccgataatcctcgtgggcaggccggttacggcacccaaggcctagctagctagcaagacgcggggcagggtggtggccctaccgcaccaagcgggatgtaactaactctcagtgattgaacgcgtagccggccatggccttcggtcaggaccggctacgcgtgtattggaagcagtgtgatgccgtcagcaccaaatttggctttcacctgcgggcctcgtccacctgaaagaccagctctgcaatgccgacccgagtgttcaccacccggctgtgttccaccagcgatagtccggcgtactgtgcgccggggacggtgttgactgccgcttccacgatcgcctgcagggtttcgtcgagactgtcctcgtcctgtaggaccctggccaggtcgctgagcttgacggcgaggtcatcgttgatcctcgcggatgactcgttgcaggctgtgtgacgagacgatccggaagctccttccgcacctcgacgcggtgagtatcgggaggattgagcagacagacgatgcgctgtggatgtcggccagcgtgcgggctcggacggtgatttgttggccctgcggcacggcgtcggaccgtgtgcacgggcagtgctcaaccgcaggctgcgcgaggtcgccaccgcccaaaggccggctggggctcggactcacgtcttatgcgcgggcggcctgaggcttctggggtgcgacttcggtgatccgccgatggggcaactcggtcggcgcagactggccatgtgggtaagcatgggggagccgccggcggtagcgccaggacgacgaccacgaccgtcggcaagaagtcaatgatgtcgaactcggccgtatcgcagggcgagcccgcggcggcccggaaccggcagctagccgatcggcaacaaccgcttcgcgccgcgagtcccgcgcatagcagcacatgccggtaaccctcctgacgaaaggacaggacatgaacgtcggcaaaaatgtcacatggttcacgtcgagccgcagtggtgccgccgggcactgtgtcgagaccgcgttcctggagaacaaccaggtggctgtccgtgacagcaagaacagggccggcccgacgctgatcttcaccggtcccgaatgggaggcgttcgtggccggcgcgaaggccggtgaattcgacctgccgtaggccgaccggtcgtaccgctggtgcgccagcggcagcatcagcggtcgctcggtcaggacttggtgccttgcaccgaccaggagtagatgtcctgctttgacagcgccgtgccggtgctgccggtgaagccgagccacgctgcgtcgacgccggtctcggcggtcaagtcgatcgactcgtcgaggacgagttcctcggtcgtgccggcgcgtaaggacttcacgtacgccttcagctcgtgtgcgtccgcgttgtaggtgatccgcgcgttgaacggccgcccgtagaggggaattgacgggtcggcggccgccatgtggtgctcggggtcgccgttgagcacgaccgcgaggtggttgctgctcgggtcggaggtgttttggaaggtgtcgaactcgaccgcgacgctcttcttgatgccccggtaacccaggccgccgccccagccgccgagggcatgcggaccgactccctggatgaggaacgcgatgccgtcggcgcctggccgtccgtggtgcaggtagaccctgaaagccgtctcgaaggagctcgtgagatcgaacttcggcagggcccacgccgagccggtctgctcgtacccaccggcggtgagccggaggatgcgctggtgccggcgaccggccaccagaatgtcggcagttccgtttcggtcgagcatgcgcgacgagccgttgaagttcgggaagtcgaccggggtgtcggcgccggcggcgaacgcgccggtcggtgtggtgatcgccgcgagtgtgagtgcgacggagcctgccagcccggcccggatgaggcgtgaaaaatgtgaacgggacacggttctgtctgcctctcgatgtcatgccagcgggaacgtgactcaacgtaggtcactatccgtgcgcgcgtgagcggatctgactattgctccgaagagcccgcacgcccgccgaaggcggcgacctgatggcccggctgcagagctgccgatggggtgactaaatgtcagtggatgcgccggctatgtggcagtgcgctctgaagccggtggggctggcgcggtagcgcaggctagcggggttagagcgtccggcagcgttgcactggccgctgcggagtcgagcagcatagccaggtcacgaggtggtgccggctcgccggtcggtgccgccgccaggatccggtcgagccggaacccgcgcgccgcgcgccgggtgcggcaccacccgatgagataccagcggccctgggaggtgagcagcccggctggttcgatctcccgttcgctgtcacgtccggcgctgtcgacgtagcacagccgaagcacggcgtgaccggtgatggcctgctctaccgcgccgcgaaccgccgggccgggccggggcggcagcgctacgacccgggcggccaggttccgggccacgtccgaggcggggccggacaacgaggcggcgatcttctgcagagccgagcggacggaccctgagtacgggacggtgctgcccacggcggcgagcgcgaggaccagggcggatgcctcgtcaggggtgaaccggatcgggggcagggtcatcgccgggtcgatcacccagccaccgcgccgtcccggcaccgcacggaccgggactccggtctccagcaaggtctgtaggtcacgctgcaccgagcgtcggctgacctcgaagcgggcggcgagcgccgcgaccgtcaccgggcgcggcgccgcagcgcgcaactcctccaccaacgcatagagcctaccggtacggttcacggcgccgacgctacccgcgcgcattgcgcaggaaatcctggccgcggcgttcctcccggtcagtgacggtcaacgggaacagggtgaacccgtgcatggcgccggcgaccacgttcagttgtacgggtgccccggcggcggtccaccgcgtcgcgaggaacagcgagtcgtccagccagggatccatcgtgccgaccacgatgcgcgctggtggcaggccggtcaggtccgcgtacaacggcgagatctgcggatcacggcgctgtaccgggtcaagcccgggggtgacgcgttcgtacgtagcccgcgctgacggggtgttggccagcaggcgacgggagccgaacaaccgctggctcggcgtcatggacaggtcgtacggcccgaacagcaaatgcgccgcctggaaggcgccgatgacgccatgtcggtcgcgtaggcgtaacagggtcagcacactcaagtgggcaccggccgactcaccgccgataagtagccgtccggcaccgaactccgcctcgctgtttttcaccagccaccgggcgaccgtttcgcagtcgtcggccccggccggcagtgggtgctcgggcgctaggcggtactcgacactgaccacggccagccgcgcttgttgggcgagccgccacagccgctcgtcctgcccatccgccgaaccgaacgtccaaccaccgccgtggatatgcaggtacacgccatcgacgtggtccgggacgaatacccgcaccggcacgtcctcgaccacccggtctcgtccctgcggcagccgcaccggtggcgcatcgccggccagccggttgcgtcgcagggtggccaacgtcgctgcgtccagcgacgcttcgcgggaaggccggctcgcggcggctgcctcaaactgtgcgttgaacgcctcggtttcggcgaggcagtcttggtcgacaaggttcatcggggaaccatcccaccggtatgcgacagcgccctgtcaccgttttggtatgggctgcctcacaacggacgacgtgcgggcggcaacgcggtagctctgtacggatttcagcgtccgttgcgaaccgccacctcgataccaagatcttccagcccgatcctcggcgtgaaccggcagccgccgaccggccccgcggagctgcctgcctgcggcagcccaggagatcaccgcgctgctgcagggaggcctgtggtgttgaggtgtaccccaagccgacacactcagcgacgcgcctgcccccgccagtaggcgaggttgtggcgggtggtcagggtgtcggggtggtcggggccgagtacccgcagatagtcgtcgagcagttgctcggaggcggtggcggcgccggccgggtctccggcctggccccgccagtaggcgaggttgtggcgggtggtcagggtgtcggggtggtcggggccgagtacccgcagatagtcgtcgagcagttgctcgaaggcggtggcggcgccggccgggtccccggcttcgccgcgccatcgggcgaggttgctgcgggtggtcagggtgtgtgggtggtcggggccgagtacccgcagccggtcggcgagcagctgctcgaaggcggtggcggcgccggccgggtctccggcctggccccgccagtaggcgaggttgtggcgggtggtcagggtgtcggggtggtcggggccgagtacccgcagccggtcggcgagcagctgttcgtaggcggtggcggcgctggtcgggtccccggcgtggccccgccagcgggcgagttggctgcgggtggtcagggtgtgggggtggtcggggccgagtacccgcagacaggtgtcgaacagtcgctggtaggcggtgatcgcggcgttgacctggccggtttctccgagacgggtaggggcgtggaacaacagcgtatgcccgtctggggtgagcagggtgtcgccggtggtggtgtgcagggcggtggtgttggcgtacagggtttgggtgtaggcgggatcgcggtcgatgtcgggccataccgtgagcagtgagtccgcggcgacggcggcaagttcgggtagccggtcgtcggggatggtgtcgcggacggcgcgttggaccagggcgtgtacccgcaccatgccggtgctggtgtcggcggtgagcaggctgagccggtgcagcgcctgcaaaccgtcccgtaactgctctgcgtcgaccggccggccgacccggctgttgacgtagccggcgaccttgtcggtgtcgaacacggtggcggggatgccgttggggtcgagcagggcggccagttcgatcaacggccgggccaccccggccggcttcaacgcgtcggccaactcgatcgacaacgcccaggtcgccgcgacggtggcctggtggtcgtcgggcagcgccccatcgtcaggtagcaggtcggccagccggcggcgtcggtcggccagccgggtgcggtagcccgtgcacgacaggttccggtccagcagatacgccgcggcctgcgccaaccccaacggcagaaaccccagatcgcaggccagttcacgcgccccatcgagcaggtgcggctggccggccagtttgtgcgtcaggtaggtgtcggcctcgacgggggtgaacaggcccagtgcgatgacgtgccggccggccagcagggcggtgtcgcggcggcgggtcgtgacgaccgtgcgtcccaccggcgggaccggtggccataggccgcgtaggtcgccggggtcggccaggtcgtccagcacgatcagccatcgccggtcggtggcggcgagccaggccagcagccgggccgcgccctgctccggatccgggtcctcgaccccgctgatctccgcggccgtccgcgagtatgcggagatgatgttgctgcgggaggtggcggtcacccagaccaacaggtccaccaggtgttcgtcccagtagcggtgggccagttcggcggccagctgcgttttaccgaccccgcccaggccggtgacgacctggcacaccacggtgtgaccgggcccggcggtgtgcagggtcgtgtcctccccacgcggctgacggcagtccgctcggggcggcactaccccgactcggtggggccaggaaatgggaacgcggccgttgacgtgcacggaaccgtagatggctccggcagtcacgccgtggttgttgccggtgtggacagggggcgggccggtgagggcgccggggacgggtggccttacgccgtcgccggcgggactggggggaccggcggcgtgtggttgaccgtcactggtgcggtgatcgtgccgccgaccacgcccgagttggttccgacattgatgttgtacgttgcggcccgcgccgggtcggctgcggccagcaacctttgcgcggcggcaaggacctgctcatcctcgacggcgccggaggcctgcaactccttggccaggcgcccctgcagcgcggtctcgtcggtctcgtcggcgtccagggcggcgcgtgcgtcaccgcgcacccacggccgcaacatcgtcttcaacccggcgtacgcgtccttgaccgcggctgatgcggtgtctttcacaccagcgcccgccccggccgccaacgccgccacaattacctcaagattcgacatccgcaccctccttagaccgcattgccaagtccacagtgttacctagcgcagcgaaacgatcaccacacagctcgtgtgtcagaaagacgccggcgcctgccaagccgtcggccggcctgccggggaaggccgtagcgcgctgccgcttgcctgctaccaggggcgcgcgccgcgcggcagccgtatggtcgggccggcgccgctgatgtctaccagcccgatgtcggcggggatcgcgatccgggtgcggccgcgccagcgaacccagagcgccactgcgcccgcgtcggcttcggccacgagtttgcgcagcgaccacaccttgccggtccggtcgatctcgatcgcgaccggcggcaggttgcccgggcgctggcacatcatgtccaggcgggcctggtacgggccattgcgggtctgccgggcgatcctggcgggcacttcacgcgcaacgtgccagccctgcccgtcggcccaggccgcaacgtgctcggttacgagcgcggtcacctctgggaaggtgcggcctttcaaccctgacgttcgccacagtgaccggcaagcgcacaggagacggcttcgccagcatcgccgcgatcgtcgacctcatcaaccacatgacccgatggcggcacatcagcggcctcgaactcatcccaccaggcaaggtcaccccacacatgttccggcgcaccatggccatgctgacccgtgacaccccaggagccgagatcgccgtcggcatgcaactcaagcatgtcgccacccgagccctggcgaaccgcatcaccagcagctacatggacaacgacccctcctgggcacgtcagctcgacaaatcgatcacggaacgccgtttcgagcgtctgaccgaactcttcgacgccgacaccgacggtcacaccatcggtttcggccctggcgccgaccgcatgcgcgaaacgttcgccgccgtccgcgcccaagccgagcagctacgcgccacaaaccaagcccgccgcggcgacatccgcgtcgaacgcgacctgctgcgccgcacccggatttcgatccggttcggcaaactcaaccactgcaccatgaacgacaacgatcccgccggggcaaagtgcctggaagacgccatcgtgccggacggccacctgggcccgctgctcgaccgcggccagcccagccgctgcgcgaacagcatcatcgcccccgcacacatcccgatctggagcgccgagcagtcgtctctgcaccacctgctggacaccgacaaactggcccccagccaccggcgccgtatcgaggccgaactcaaggaagtagaccgcgtcctcgatcggcaccacccatgagcgtcggcgtgtcgcccgccacccggcaacgacttcgtgcggcgatgcaacggctgttcgacagccgaccacagcacaccgacggcacgctgaccaagaacaacctctggcgtgaagcccaagtcagccgggccacgatgaaccgcgccgctgacatccttgccgaatgggacgcccgccccggtgacagccctaccggcctggccgttcgccgtcgcgatgaacaactagagcaactacgcgaacgtctgcgcgccagcacccttgagcgccgcacgctgcaagcgcagcttgacgccgccgccacggtgatcgctgcgctgcacaccgagaacaccgcgctacgccgccaagccaccgaccccagctctcaccttgtcccgttccgacgacgccctggccgggaaggacctgcgcagtaacgtgcgggccggggcggctactcgggcatttgcgcggccgagacgtcccggtcgtccagcacaccccggtacaccgggtgccgtagctgggcgcggctggtccaggaccggtaggcgatgcgggcgaccacctgcgggtcgacccaagtcgcctcggtcatggccatggcctcggcggcgatctggccggctcgggcgacggtccgggcgaggtcaaggcgatcaaccgggccgacctgctgaccaggtatctgaacgactaccggttcttcctccagaagatcggccggtcgccggacatgatcgacatcgagcctgacttctggggctatgtccggtccctcggcaatccgcaccgggtggccgcgcaggtgaccgcggcgaatccgaaggattgcggtgcccaggagaacagtgccgcgggcctggctcgttgcctgatcgcgatggcgcgcaggtacgcgccgaagaccaccgtgggcatgcacctgtcctgctgggactggcagaccgacagtgcggggtgcgcccgggactatcgggacctcggcgcatcgaaggccgacttcctggtcggcgacgtgtcggaccgggatgcgggctggtacgcgctgccgcagcacggcggctccaacggcttctggaccgacgcgaaggccgccgcggccctgcggttctacaagtcgatgaccgaggcggtgggccggccgctcgcgctgtggcaggtcccggtgggcaacatggcgcagaacaacaccctcaaccattatcgggatgacaaggtggactggttcttcgcccacatggaccaggtggcggccgcgcacgtcgtcgccctgctgttcggtgcgggtcagcaggagcagacctctctcctgtcccgaggccctccgccggcaagcccggacaccccgagcccctgcgcgccagcgccggaatcgacccgcagagcatcgacaactggtcgcagggcgacgtgacgctggtgaccggggaaaccgcgaccgcactggagttgaccgtccgcgtcgtcaccacgccgtacctgtccagctccggattctggagcacgataccggccgaccacctgaccacgacggtcgagcaacagcccggcgcgctggtctaccggttcacgctgaagccgggaacgagtctcggcgccggctcgtacaccttcgccgtgcagtaccaccacgctgtcggcggccgggatcccggccgggacacctaccgggcgacggccaccgtcggcggcaggccggtcgcggtgagcgggggcttctgaggccgttccccacgccggcggtcacttgtcgatcttcaccttgacgatggtgtcggacaggatgccgtcggacagccgcaggtaggcgaatttcgagtcggtgggcacgtcgtagacgaggaagctgtcgacggtcttccccggatcgatcggcttgctgaggtcgtcggtgttcttgttcaggtaccactcggcgctggtgttccggctgaacacgcgctcggtggggctggaggcctccaggtcgaacgtgggataggtgtcggtcctggcgccgacgttcttcgccgagaaggcgatgacgcagaactttccctcggccttgatgacgtcgctctcgtcccacgaggtcgccgggtcgtcggccgtcctggtcatcgactgtttcgtgcagtcgacgctgcggaccgtcgcctcgaatcccttgacctgtgcggtggctccgatcgccacctcctgcaccttcttctcgggaggctgatacgagtagtccgcggcggagtgcgagaagctggagaagatcgggaccatgacgatcagcaggaacaccagcattccgccgccggcgatccaggcgatcttcttctgccggcggaccaggtccggcgtgaggagcggccgggtgctgacggtgatgcgcggcatgccggtggcacccgcgccgaagggccagccggtctgcgcgcccggcaggggcgactcccgccggcagtacgggcatcgcatcaccccggcgtcgtgggcgacctccatcgccgcgccgcaggacgggcaggtggaggacgtgtcggcggtctgccccggggcggtcatcgcggcatcgggggcggcgtggtggcgaacagggcggcgagctccggctggtcgccggccggcgaccactgggccatcccggcccgccacaccagcgtctcccgggtgatcgcaccggtgcccacctgcaccccgagggtgccgagctcgaagggaccctgctggctgccatgcagagccacgtaccacggcgtgctcaccggcagcggtggtggttgcaccggcatggcgggcggcgcggcggccccgcccacccgctggccgaagagcatcccgacgcccattccggtgcccagcccggcggcgccggggttgcgggcggcgtcctcgatcgcgttggcggtctggaacgtcgtgtatcgctgcaggtcgccgatgatgcccatctgggtacgccggtccagggcctgctccacctcgggcggcaccgagatgttccggacgatcaccgccgggatccgcagtcccatcggggcgacctgcccggcgagcgcctcggtgagttgcgcgccgatcgcctcctgctgggccgccatgtcgagcagggacacgttcgcggcggcgagagcggacgtcaaccggctcacgatcatctgctggagatacccggcgacctcttcggtgcggaactccggatcggtgcccaccagttcggtgagcaacagccgcgggtcggtgatgcgcagcgcgtacgcaccgtgggcccgcagccgcaccatgccgaattcggggtcccggacgatcaccgggttctgggtgccccacttcaggtcggtgaactgccgggtgttgacgaagtacacctcggccttgaacggcgactcgaatccgtaccgccaacccttgagggtggacagcacggggaggttctgggtggtgagagtgtgcgtgccggggccgaaggcgtccgcgatggtgccctcgttcaccaggaccgccacctgcgattcgcggaccacgaggcgggcattcatcttgatctcgttgtggtaccgcgggaatcgccagacgatcgtgtcgcggctgtcgtccagccactcgacgatgtcgataaattcgccgcgtatcttgtctgccatcgacattccggacctacccgacatctttcaggcggccggtgtccggctcgcgtcatccgcgccggatggtatcaaccgggatcgacattccccgccgggagccgcctgaccggtgggacaggcggctcctcgtcagccggcgatcagttgagtttcggggcgtcgtagaggtccgaggcggacaggttcgggaccgcgctgccgtccctgaggcgcagggtgatcgtggtcggccgggtctcgccggctttctccgggtaccaggcgaggaagtagtggtcgtcgaccgtggcctcgaccttccggccgtccggcgtggtgaccgccaccccggtgacgtcggtgccgaggtgcccggacatcagccgcgcgtacccctcgtcggtcttgagctggccccaggcctgcagttcgacgcccttggcgcccagctgcccgtcgctgaccggcgactcgaacgagctgccccagtacacggtcccggccttgtcgcggaagcaggtggcggtccactgctgtgtcgcgatggcgacgtaccggtacgcgccgcgggcttcgccgagaaccttgcgggcatggtcgagctgcgcctgggtgtagccccagtcgggggtcagcttctgcgtcatgcagtcccggctgagcgcctgggtgtcgccggcgcccagggcggcgggggtcccggtccacgacgcgtacgccgcctggtcaccgctgagaccggggatcaccaggaccgcggcggacacggccgcggcggcgagaccggccaccgcccagcggccggtgtggcgtaccgcccggcgcggggcggtgaccggcgccccgccggtgcgcggcgagcggacgatgcggtccagcaggtcctgggcggacgggtggtgcacgcggccccggcccacgggttcggccgcggcccgcagccgcacgtcgaggtctcggtggtcgttgctgttcatcggttcactcctgagtcgctggtgggggcggcggcggccgcgaccccggtgtagtgcctacgcaggcggcggcgggcacgcatgagccgcaggctgaaagcggtggtcgagatgcccagcacccgggcggcctgcggcccggtcaggccgtccagcgcgatcagcgcgatgacctgctggtcgtcctggctgagctgctcccaggcgcggttgaggtcgacgcggccggcgatgtccaccgcctcggcgaccgggtccggtccgccgggttcgcgcaggatgcgcagggccagcgcgtgctgccggtgatcgctgcgccgccggttgcgcagcacatggtgagccaccgtgaacagccaggcacgggccggatccaggtcaccggggatgtcgtcgaggcggcgccaggcggtgaggaagacctccgcgacgacgtcctcggcggccagctggtgggtgcggcgttcgacgaagcagagcaggtcgtcgtaggtcgcctcgaacagggctcggaaggtggcctcgtcgtcccgcggggtttccgctcgccgctcggccaccatcggggcattggatcggttcacaccccctcatgtccatccgggcggcgatcacttcaccccgttttccgcggggtcgcggcgaccccgttctccgcgggatcgcggcgggtctccggcgatcgtgggcgggatgcgaccgaccgcgatgaatctttgcggagttattgcagatcagccttcatgatcgcgcgggcggcggccggacggggtagagggcgcgtggcgatctcattactgtccctcgatgtgggacgaccgccgtcccgtcgagtggcggatgccctcgtgtgcatgcgcgctcggacagctgaggggagctgacatgagcaacttcttgatcaaggcgggagaccgcctgctggcccgcgtcctgcggaccgaggtcgccggggcctgcgtcccggaccacggccagagctgcggatccatcacctacgtctgtcacctgggccggctctacaagcacgacccgggccgggtgcagtgcaacggccagtgcgtcaccaccgtcacctacgtcggcacctgcgactgatcgtgtgatcgacgggcggcgggcccggatccgccgcccgcccggacgtgaggggacgtctatgagcatcaccgtcgcggtcgcgctggccctggtcggcgccgtcaccgtgctcaacctgttcctgctcaccgcggtcatgcggcgcctgcgcgcgcacgaggccgcgcacgcgccggccgcgctggcgctgcccgagcccggtcaccggatcggcgcgttccgcacgaccaccccggacgcactgtcggaggaggacctcgccgagccggccgtcgtgctgttcgtgatgcccggctgcgcgccctgccacgagctgctggacgcggtgccggacgccggcttcgacccggcgcgtaccttcgtcctggtggccggcgacgccgcgctggcgcccacccgggagctggccgcgctggtgcgcccgctgggccgggtcgcggtgatcgacccggacggaccggtgaccgccgcgttcggcggcatccggggctatccgacggtggtgcacgtcgccgcgggccgggtggtcgccgccgaccgcaggctgagcgtgctggtccgctccgcggccggagcgtgatggcgggctccggcttctcccgggccgcggcgatctgcctgcggctcagctgggccgcgagccggccggccacggtcgcggtgatcgggctgtccgcggtcgccagtgtgctgcccgcgacgaccgcctggttcggcaaggagctgatcgacgagctgacccgcgggccggccgccgccaccggccgggccaccgtgttcgcggtggccgccgcgctggccggcgcggtgttcgccgggctggcgcagctcggcactttggccggggcgtacctgcagcgggagaccaacgcgcggatccaggagcggctgttcgcggcggtcaacggcttccacggcgtccgccgcttcgaggatccggccttccgggaccggctggagctggccggcaccggcgcgcagcaggctccggagagcgtcaccacgatgctctccggtaccctgcggggcgttctgaccatcgccggatacgcgggtgtgctgctgaccgtgtggccaccgatgctgctcctgctcgccctggccgcggtgcccgccttcgccacgtaccgccggatcggccgccgcgccgccggggtcagcgagtccaccgtggcccgcatccgccggcagctctcctaccggatgctgatgaccgaggcggtcgccgcccgggaggtgcggctgttcgggttgggccggctcttcgccggtcggttcgccgcgtcgctgcgcgagacgtccggcgcggagctcgccgaccggcggcgggcagccggcgccgagaccctgttgagcctggccggggcggtcgtcgcgctggccggcacgctggtgatgatccgcgaggtggccgccggccggctcagcgtcggcgggttcagcctgttcaccgccgccgcgatcggcgtgcagggcgcgctcacctcggtcctctcccagatcggcatggccacccgcaacctggccctgttccaccactacgccgaggtggtgggcgcggccccggacctggccgacggagaccgcccggtcgccccgctgaccgacgcggtcaccctggacgacgtctggttccgctacgacgaggacggtccgtggatcctgcgcggggtgacgctgcggatcccgcgcggcgccacggtcgggctggtcgggctcaacggcgccggcaagagcacgctggtcaagctgctctgccggttctacgatccgcagcggggcacggtccgctgggacggcaccgacctgcgcgacctgcggatcgccggcttgcggcggcggctcggcgcggcgttccaggatttcgtccggtacgacctgaccgccgccgagaacatcggagtgggtgacgtcgatcggctcgacgaccgcccggcgatccgggcagcggcccgggccgccgggatcgacgcggccgtcgaggcgctgccgaagggctacgacacgctgatcagccggatcttcctggacggtgacgacgccgacgagggggtcaacctctccggcggccagtggcagcggctcgcggtcgcccgggcgctgatgcgcgaggactgcgatctggtcatcctggacgagccgaacgccggcctggacgccgacgccgacgccgagatccaggcggcgctgcgcgcccacgccggcgaccgcaccacgctgctggtctcgcaccggctcggcacgctgcgccacgccgacgagatcgtggtgctctccggcggccggatcaccgagcggggcgaccacgacacgctgctcgccgccggcggcgagtacgcccggctgttccgcaaacagtcggccggctacgtgcccgcgggaggctgacatgtggtggctcgcggtgctcgccgtgccgctcgcggtggcggccgcggcccgggccgggttgcgggtggtcgaggtgcgggggcacagcatgaacccggcgtacgccgacggcgaccggatcctggtccggcgcggccgggcccggaccggccgcccggtcgtcttccgccgcccggatctcgccggcccggccgcggccgacgtcgactggctggtcaaacgggtcgtcgcgacggccggccagccggtgccgcaggcgctggccggcgtcgtcccggacgccgtcgtgccgcccggccggctgctggtccgcggcgacaacccgcacagcatcgactcacgccacttcggctacgtcgcggaggccgacgtgctcggcgtcgcgatccgccggctgtccaccggaacgggagtgcccgatcgtgccgtgccttgagatcgccgcccggctgctgatcggcacggtgttcgcggtcgccgtggccggcaaggtgcgctccggcgccgcgtaccgggaacacgtccggtcgctgcggcggatgggcgtgctgccggaccgatgggtgccggccgcggcgggcgccgcggccggggcggaggcggtggtcgtggtgctgctcgcggtgccggcccggtggaccggggtgcccgggttcgctctggccggtggactgctggcggtgttcacggcggcgatcgcggtcagcctgcgcggcggcaaccgtgccccgtgccgctgtttcggcgcgtccagcacaccactgggcggtgcccacgtcgtacgcaatctgctgctcctcggtgtcgatctcgcagccctgaccgcgatgttcgtcgcggcgcggccggcgaccctggccggcggcgtcgtcgcggccctggccgggctgatcgccggcgccctggtgaccagctatgacgacatcgtcgcgctgtggcgcccggcgtgatcggcatcggtcagggtccatgatggagtgggcggcatcgccggttccaacagggcgctttcctgttcactagatcgatgaccgtcgcctgtcacccgatagccagggggacaatcggccgggtacggtacagacctcgtagccggtgatcttctgccgtttcgatacgacagaggtctgatgggggagcaatcgatggccgagccgggtcgctggaggggctggttgcggcggcggcgggtggagcagggcggacccggcaggcacgccgctccggagaccccggcgccgccggcgacgcagcccgagccggtggtgcgcgccgcggacaggacggacccgtggcgcccgatcgccggggagttcgcgctccggctgctcacccttacgtgggaagccgttcatcacatcggggaagccgaattccgcgagcaggacgccgaacgccgccagatcctgttccggatcgaccactcggtgacccgggtgcggcgactcgccgagaatttgcgggtgctcaccggcgagccgctcgacgaccctgatcagcaggtgacctcgctgcacgacgtgacgcacgcggccggggccgcggtcgagcactacgagcggctgcacttcggcccgatcgccgacctggcggtcaccgcgaccgccgccgacgacgtgatccggatcctcaccgagctgatcgacaacgctgaccggtactcgccgccgaccgaaccggtcaccatcgccgcgcacctgaccggcgacggcgacgtggtgatccgggtcgaggacaccggcatcgggctgaacccggcgcacctgccgtggatcgagagactgctgaccgacggccccggcgacggcgagctgcagccggcccacctggggctggccgtcgccgcggtgctcacccaccgccacggttcgctgcgcgtgcgcctggtgccccgccagccgcgcggcaccgtcgcgatgctgctgatcggcgccgacctgctctgcgagtccccccgggtcgccccggacgagtcgccggccgagaagccacagccggcgccgaacggccggaaccaccggaacgacgtcaccatggtgctcccggcgatgccgaaaccgatgccgcgccgggtgccggccagcgtccgggccaacggcgcgaccctgccgccgccgcccccggcctccaccgccacccacgagaccacctggcacgacgacgccgccgcgttcaacgccggcgtcgacgccgcccgcgcccagcaggaaagccccccaggcatcatggaagctgaaggaccgcaatgactgacacccagcaaccggacgtctcctggctgatcggccagctcgtccgcgaggtaccgacgatcaccgcggtcgtcctggtctccgccgacggcctgcaactggcctcgtccgggcacctgagccgggagcacgcggagagcgtcgccgcgctcgccgccggattcctcggcatcaccggccagctcggcggcctgctgcagctcggcgccccggagaacctgagcatccgctacccgcacggccacctggcgttcctgcggatcgacgacccggccggcgagttcgtcgcggcgctgctggtcgcggcccaaccgcaaacccagatcggacatctcgggtacgccatgaccaccttcagccaagcggtcgggcacgccctgactccggagacccgtcacgcgctgcaccagcgcaccctgcccgcaccggttcgctgagcggaggccaccatgggccgaaggccgggactgcactggaaggtgcgcccgtacatgaccgcgcggggccgcaccggcagccgcagccccctgttgatgcacaccctggtgtcgaccggaaaccggtacgacccggtgctggccgccagcctcaccccggcctcccggtccctctacgagcaggcccgccggacatcctcggtggccgagctgtcggcatcctgcgggctgccgctgggcctgacccggctgctgatcagcgatctgctcaaaatcgatcagctggtggtgcacgacgctcgcccctcgcaagatctagcactcctggagagacttcgtgcaggcctcctccgcctcacctgagatgcactctgccaagatcgttatcgccggtgggttcggcgtcggcaagaccaccgcggtcgaggcgatctcggagatcccggcgatccgcaccgagtcgtggatgaccgcggccgccgcccagatcgaccacctcgatcccggtatcgacaaggtcaccaccacggtcgccatggacttcggccgcgtcacggtcgacgattctcttgtgctgtatctgttcggcacaccgggccagccccggttctggccgatgtgggacgacctggtccggggcgcggtcggcgccctggtcctggtcgacaccaaccatctggagaactcgttcgccgcggtcaactacttcgagaacgacgccgcggtgccatggatcgtctgcgtcaacctcttccacggggtgcagacccacgacctggccgaggtccgggaggcgctcacgctgcccccgcacatcccgctgatcgccgcggacgtccgcggctcccgcaacgtcgcgcaggcactgctggccgtggtgaaccacgcgacggagaaagcccgtcagtaacaggaggcatccccccatgcgcaagattctgatcgtcggagccggccaggccggactccaactcgccctcagcctgcacgccgaaggctacgaggtcaccctcatgtcggcccgcacccccgacgagatccgcaccggctggcccacctccacccaggccatgttcgacctcgccctcggcaccgaacgggcgtacgacctcaaccactgggagcacgtcaccccacccatccacggcctgcgcccgcagctgtcggtcgaacgcggccgactcgccctggccttcaacgccccgctggagcgcccggcccagtccaccgaccagcggatcaagatgtcccgctggctgcaggatgccgaggagcgcggcgtcgaggtgatctacaacgcggtcaccacccaggacctggacgcgatcacccagctcggccgctacgacctgaccgtggtcgccgccggcaagggcgacctggtcgccatgttcgaccgtgacccggagcgctccccgtattccaccccccagcgcggtctggccgtcgcctacgtccacggtctcgaaccggacccggcctggcccgacccgcacgtcggcttccacgccctgcccggcctcggcgaactgttcgtcatcccggccctcacccacaccggcccgtgcgacatcctcttctgggaggcgatccccggcggccccctcgaccgctgggccggccaccccggccggatggcccccgaccagcatttggccatcaccctggaactggcccgcgaacacctgccctggctgcacgcccgcgcggagaaggtcgagctcaccgacgccaaagccactctgcacgggcggtacacgcccacggtgcgccggccggtcggccacctgccgggcggcggggtggcccttgggctggccgacgtcgtcatcgccaacgatccgatcaccgggcagggcagcaacaccgcggccaaagcggcccaccactacctgcaggcgatcctggcccggggcgacgaggcattcgacgaagcctggatgaacgcgaccttcgaaagcttctggggggcgcacggggcggcggtcaccggctggaccaacgcgatgctgcagcccctgccgccgcacgtgcagcaactgctgggggcggctaccgggagtgagacgatcgcccgtcggttcgcggccggcttcaacgacccgaacgacttcctgaactggttcgtggacccggagaaggcggcggcctacctcgccgaggtcagcggggcgtaaccgacccgacagcgggcgcaccctcccggagcgcccgcctgtctaccgggaagcaggattcgtggcggctgcgggacgccgtcccgcggtctgcggacgatccgggttgagcgctgggcggcaagcgccggggacagcgcagcggcgctgcccggggagggtggcgccgctgcgggaggggtgggctcagtgggcctcgccgaggaggcggcggacttcggccaggagctcggcctggaaggcggctacgttgccgtccacgacgccgatgcggtaatcggacccggtttccggatcgtctgccagttgggcgtcgcggcgtcccgccgagccgtcggcgtggccggcggtgtacgccagaaaagcttcttccatcaacggggcctcctcgaacacgcgggccaatctcgcatggatacggatgcgagggggccatccgttcgaccggatcgccgccagttgatcgtccgggccactcagcccttcaggtggatcttggcgcgggggcggctccaccacagcgacagcgccaggccggtgacgacgaggacggcgccgaccaggacgaaccagaagctgatgtcgacgtcggcccggtgcaggccgatctccttcggcagatcgtgcaggacgccgttgagctcgtcggcgtcctgggccttgaagtagcggccaccggtcaggtcggccacctggttcagggcgtcctcgtcgatctcctggacccggccgtggccgccgccgaagccgccaccgcccgggagaccgccgccgcccggaaacgagtcgccgctgacctggtcggccgtgcacaccatcggcgacggcctggtcgttccgaaaccgatggtgaagatccggacccggcgggccgcggcctcccgggcggcggtgaccgggtcgacgccggtggtgttcgaaccgtcggtgagcaccacgatggtgtccgactcgtagtcgccgcgggcaatggtgtcgcccagatcggcgccggtggccgggacggccgggttcatctcggcgatggcgtcgatcgacgtgaggatggcctggccgatcgccgtgccgcgggccgttttcagggtgtcgatggcgtcgagcagttcgtccctgtcggtggtgggggcgaccagcaggccggcgatgccggagaaggcgaccagaccgattctggtgccgtcgctctgcgaggtgacgaatcggcgggccgagtcgacggcggcggacaggcggttcggggtgacgtccgtgctgcacatcgacccggagacgtcgatggccagcaggatcgacgtgttgtcggactccaccgggacccgcgcctgcgggcgggccacgccgccggccagggcgagcaggccggccaggaacaggacgaccgggatgcggcggtgccagtcggagcggccggggagggcggcgcggatcagggcgacgctggacaccgtgaccgcggtgcgtctgcggcggcggttcagccaccagcgggcgacgagtagcagcgggacgaccagcagtgcggccagcgcccacggccagtggaaagacatcagatgatccttccgtgccagcgggtgccgagcagcccaccgagcgccagcagcagcaacgcggccccggcgaacggggcggtcagctccagcggctccttcctcgtggtcagccgcaggtcgatcgacgacgtggcccggttcagcgtgtcggcgtccccggccgcgtgataggcgccaccggtgacctgggcgaccgcggtcagcgtgcgctcatccagggcggtgttcaggtggtagccgtcgacctcgacggtggcgccccgggcggtgcccacgcccaccgtctgaatccgcaccccggccgcggcggccatctcggcggcggcttcgacgtccgggccgccggtgttctcgccgtccgagaagatcaccatggtggccgacggccagtagccgagcgtcctggtgtccgccgtcccgccgtccttgggcaggctgaccggtttgccggtgatggtgcccaggccgaccaggatggcctggcccagcgacgtgccgccgccgggtctgacccgggcgatggcggcttccgcggccgggtggtcgccggtcggcgcctgggtgagcagcgcggtgtcgccgaagacgagcacgccgacgtcgaccgtgtccggctgggcctcgacgaactcggtggcggcggcctgcgcggcggccagccgggtggggctgacgtcggtggcggccatgctgttggagatgtcgaaggtgagcagcacggtcccggacacccgcggcaccgacacccgcgcctgcggccgggccaggccgacgagcaggatgggcagggcggcgaggaacaacgcgtacggcaggtgacgtctcaagccgccgccgatcagcgcaccgaaaccggacgccttcaacgccgctgcgcggcgtctctgcagaccgacgtagaagacgacggcaccgatggtgagcaggaccgccacgatgagcaggtacgggtaccgaaagctcaccgccgcccccttcccgacgcctgcaccagatggaccagcgccgccatcaggtcctggtccgtggtgatccggtgattcgccaccccggcccggcgcatcacgtcggcgagtccggcctcgcgggcgcgcacctgatcggccagccgcccgcgcagcaccgggtcgccggtgtcgaccagcagctgctcgccggtctcggcgtcctcgaccaggatcacacccaggtcgggcaggacgagttcggccgggtcgacgacccggatcaccaccacctcgtgccggtgggtgagctgaccgagcgggcggtgccagccgggcgcgccgatgaagtcgctcatcacgaagatcaggcagcggcgtcgggcggtggtggtcgcggccagccgcagcatcgcggccaggtcggtgccggcggcgggcggctccgtggccctgcggaaccgtttcggttctgccgtggccggcggtttgagcagctcgtgggcgatccgcaggacctggtcgcggccggcgcgcggcgggatcacccgctgcgcggcgttgtcgaacaggatcgcgccgacccggttgccgccccgggacaccacccgggccaggctcaccgcgagttcggtcgccgccgactccttcccctcgtaaccgccgaagcgcatcgacgccgacttgtcgatcaccagccaggcggtcagctcgcgatcctcggtgtactgccggacgtgcgggtcgtccagccgggcggtcacgttccagtcgatgtgccggacgtcgtcctccggcgtgtaggcgcgcaggtcggtgaagtcgagcccgccgccgtgccacaccgtgcggtacgcgccctgcagtcgcccgtcgaggcgacggccgagctgccactccaggcgccgcagcagccggtcgggtgggctggtcatgggtcagcggccccggccggcgggctccgggaacggcaggttcgccaggatcttggcgaggatcacgtcgggggtgacatcgtcggagagggcctcgtaggagagcaccatccggtgtcgcagcacgtccagggcgagatcggagaggtcctccgggacaacatagtcacggccccggaggtacgcgagggcccgcgccgccagcaccagactgatcgacgcgcgcggactcgcaccgaaggtcacgtaccgcgagaggtccgtcaaaccgaccgtggccgggtcgcgcgacgcggtggccagctgcaccgcgaactcgatcagcgacgggtcgacgtagacctggtcggcggcctgctgcagggtgaccagggtgtccgggtcgatgatccgctggagcaccgcggccggggccagggcccgctcgaccaccacgaactcctcggtggcggtcgggtagccgatcaccaccttcatcatgaaccggtcgacctgcgcctccggcagtggatagacgccctcgttctcgatcgggttctgggtggccatcaccaggaacgggttcggcagtcggtgcgtctggcggccgatcgtgacctggcgctcctgcatcgtctccagcagcgcgctctgcaccttcgccggcgcccggttgatctcgtcggccagcagcaggttggtgaagaccgggccgagctgcaccttgaactcgccgctgggctggtggtacacccgggtgccgacgatgtccgcgggcaccaggtcgggggtgaactgcacccggtggaactccccgccgatcgcctcggccagcgatttcacggcgagggtcttggccagtccgggcaccccctcgaccaggatgtggccgcgcgccagcagcgccacgaccaggcgttccagcaggatgtcctggcccacgatgatcttcttgacctcgtagagcaccttctcgatgtctccggcggcggccggcggggcgtcgttcccggtcatctgtcccgtcctcgctctacaggggtggtgctcgtccgtcgccctgctcgccaccgccgagcgcggcgccgatcgggacggcgaaaccgatgccgatgaaggtgccggccccgctcgggttggccagcgagaccacgatcccgaccacctgaccctggtcgtcgaccagcggcccgcccgagttgcccgggttgaccgcggcgtcgaactggatcagcccggcgatgtcaccctgctcgtcccggtcgagcctgcggtccagcccggagaccacgccgctggtcgtcgaatcgaccaggccgagcgggttgccgatcgccaccaccgggtcgcccacctcgacgccgccgccgagcaccgcgggcaccagcgtgtccggcagcttcgccggggtcagcgtggcgatgtccagcttcgggttgctcctcgccaccttggccggggcggtggttccgtcggcgaaggtcagcttgatcgtctcggcgccgtcgaccacgtggtcggcggtcatcacggtgccgtccgcgttcgcgaccacgccggtgccggtggccgactccagcgccttcttcgcgtcgtggccggtggtctggatcagcaccacggacggcagcaacgtctgatagatctgggagaccgcgagcggtcccggcgaggcggacggtttcggctgcggcgcggtggcctgcggggtggctttcggcccgccgcgcaggaacaccaccgcggtgatcaccacggcccagagcgcgaccagggcgaacagcgccttgcggcgacgctcgggcgagttccacgagctcagccgggtcggggtgggctcctgcggagcgggctccgggggatcggagccgtccggccggagcacggtcatcacggcacgaccgccacactcagcatttcttgacgctacaagcgatttcccggaattccccgtgcggccgccaatggtctccggtacgcaagatcgcccattaacccgtaaagcaggcataacggggagctgtcagctcgtccccgagactgcccggcgcatccggccggcatcggccgaccaccgcgccgggcgccgggacctgaagccacagggaccgcctacaggacggacagcccgctcacatccaggccggcgacgatctcctcatcggacgagcccaaggagtcgccgcaatgagcagcaacgaagaagccgaccttcccaccgcgccgaacctcttcccggccggtgcggtgaccaccctcccggcccgcgacccatggtccggggccgccgctccggcagccgcggggccggccgccgagaccgtgccgaccgccccggaatggacccgcaccggccagatcctggaggtcgccgggacttcgtccgccggctctccgtccgctggcgggccggcgacgggccccgtgtccgccgggacttcgtccgccggctctccgtccgctggcgggccggtgacgggccccgtgtccgccgggactccggccgccgagatcccgatgagcccgcaggccgtcccgccgggcgccgtgccgccgcccggatcgtgggcgccggtggccgtggcggggaggaagccgcgcagcccgaagacgatcctgatcgccgccgtcctggccaccgcggtggccagctccggcatcaccgccgggatcatgtccgcggtcggcggatcgtcgaccccggcgagttctcagcagggcgggccgggcgggcgcggtgggttccccggtggaggcggcggcttcggcgggatggaccagaacggcaccacccaggacgggaccaccgggcagggcggcatcgggcagggcggcgctgggcagggcggcattgggcagggcggcgccgggcagggtgggaccgcgcagaacgggaccactcagcaagggcggaccgggcagggcggcaccaccggcaccggcacctgacccggaccgtcatcggtgacacggcgcgaggcgtgccccttccgggtgcgcctcgtcgcatgcccggacccgggcggaatcggcgcgcggcggccggagcttgccgacgtaccgccgcaatcggctcgggaagtggagcgcggccgggagggggcagcggatccggagcgggcgtgtcggatcgaggacgggggagtggccccgggcggggagcggaccaggctggacggtgacgcgaacagtgtcgggggtggtcggtgtgggcggtgagttcgtggtgcgggggcggatcctgctgccggccggggagcggccggtgcgggccgcgcgggtggtgacccgggccgaggacgccgggcgggccgacgcgcccgcggtggtgatcgccgaggcggtgcaggaggccgtggcgttgccgggccgcgacggcgtgccgttcgagatcagggtgccggccgctgcggccggacggtgcacgctgcggttccacgtcgacgtcaccgggtcgggcggggtgaccgccggtgactacgtgtcgacccgggtgtatccggtcgccgccttcccggccggcctcgacgtgccgatgagtcgcgtcacctgacagattcgcaatgaggcgaaggagtacgcgatgacacaggtggagacgccgggtccatggcgtaaccagggcgagttccgcggtggcgaacgcggcaccgcgatgatctccggggtcacgttccgtccccggccggtggtgttcagccggatcgacgggctggcgatcttcgagggggacatcgccctcggcaccgtggaacaactggaacggcagctcgcggacgcgcgcgagcaggccgtggccggcgacatcgcctccgcggtggcgatcagcggcacccggttccggtggccgaacgcgctgatcccgtacgagatcgacccggccctgccggaccagcggcgggtgaccgacgcgatcgcccactgggaggcgaacacccggatccggttcgtggcgcggaccgcggccaacgccgggcagtacccgaactacgtccggttcagcgagcagggcggctgctggtcgttcgtcggcatgcagggcaacggcatgcagacgatcagtctgggcgccggctgcacggccggaaacgcgatccacgagatcgggcacgcggtcggtctgtggcacgagcagagccgcgaggaccgcgacatgttcgtccggatcaactgggccaacatccaggccggcctggaacacaacttcgaccagcacatcaccgacggcgacgacctcgagggctacgactacggctcgatcatgcattacccgcggaacgcgttcagcgccaacggtcaggacaccatcgtgccgctgcaggcgaacgtgcagatcggccagcggacgaaactgtcggcgagcgacgtggccgccgtccaccagatgtacgcggcgatcctgggaggaggctgggccggcggctggagcgaactgtacagcgacagcgaccacctcagctccctcgacgtgatcgccaacgccgacggccggctggaactcttcggcgtcaacgaggacgaccggatctggcacacctggcagacccggcccagcagcggctgggccggcggatgggccgagctgtacagcgacgtcgaccggctcacccagctgcgcgcggcccgcaaccgggacggccggctggagctcttcggggtgaaccgggacggccggatctggcacacctggcagaccgcgcccggcaacgggtgggccggcggctgggccgagctctacggcccgcacgaccggctcgtctccctcgacgtgatcaacaacgcggacgggcggctggaggtcttcgggatcaacgccgaggggcggatctggcacacctggcagaccgcgcccgacaacggctggaacggtggctgggccgagctgtacagcccggtcgaccgcctgcacaccctccgcgcggcccgggacgccgacggccgcctggagatcttcgggagcaacgccgagggccggatctggcacacctggcaggtgcggcccaacggtggctgggtcaacggctggagcgagctgtacagcccggtggaccggctcgtctccctcgacgtgatcaacaacgcggacgggcggctggaggtcttcgggatcaacgccgagggccggatctggcacacctggcagaccgctccgagcaacggctggaacggcggctgggccgagctgtacagccggaccgaccggctccgggtactgcgcgccgcccgcaacgccgacggccgcctcgaaatcttcggggtgaacagccagggacggatctggcacacctggcagatgcggcccgacggcggctggatcggcggctggcgcgagctctacaccgacagtgactacctgaccaacctggccgtgctcgccaacgccgacggccggctcgaagtgttcgggctcggcgaaaaaggccgtatctggcacacctggcagctttgagctgccctttcccgagtggccgggcccgccccggccactcggcccgaccccgctgcgatgggggttcggggggtcggctaatgtttctctcgtcgccggggagaccgggcggcaacgcggacgtagcgcagctggtagcgcatcaccttgccaaggtgagggtcgcgggttcgaatcccgtcgtccgctcggagaggctgttgcggttcctcgcgaacggcctgctcggtggagtggccgagaggcgaggcaacggcctgcaaagccgtgtacacgggttcaaatcccgtctccacctcgctttgcatttgtgctctagctagctagagcttttcgacatgttggcaactcgcggcggggggtatttgcagattgggcttgcggaatctgatttcccccttctgactgtgggcttccaggatgggcaagcggtagttcacctttttaccgaccccgaaaccgtacttctgctcgaaggtgacggagtcgccccgccgggatctctagtggaggtgccggtacagggagaaatggccgtctttgccggagattttgttctcgacctaaaccatgctcggaatgtattgctcgatttctgtcgaggtgtacccccagccgagatgggggcttgggaagagctctagtctagtgctccggcaggagatctgttctgagctagtgcgttgaccacgaacgttcaccgggtctgatcgttaggcggccttggttcggggtcggccccagcgttgttggcgttcgctgcgggctcgggctcgttcgcggcgttgcgcggccaggacgtcggggtggcgggcgttggcgttgcgccagcgcaggtattgctgcagtttgcgggccaggacggtgtggtttgggtggttcgagttcgccatggtgaacatgcgtagcggcccgaactgcgcctcgatcgggttggcccaggacgcgctggtcggcgtcaggcacagctcgaccttgttacgagcggcccaggcccggatggtcggtgttttgttcgccgacaggtaggacggcgcagcttgcgctgacgggacgggccggggggcggcccgcccggtcagcggcatgcggtcagcggtggtaggtgcgggtgctgctgtgggagacgttgccggctttgtcgtaggcgcgtagctgcacggtgaacgtcctgccgtacttggccgggttcaggacgaagcggtagccgggggtggtgtcggtggcaacgatcttgccgttgaccaacatttgcaccttggcgatccggttgtggtcgctggcggtggcggtgatcgtggcggtcttggtcagtttggcgccgttggcgggtgctgcgccgaacgcgagggccggtttggtgttgtcgacgacgacggtgcggctggcggaggtttcgttgccgaagcggtcggtggcctgccaggtgtaggtgagtcggccgtcgcgtccggtcggcacctgctgctgggaatttccgctggcggcgtcgctgccgctgtacacggtgaagtcggcgacgccgttggggtcgctggcgacgacggtcgtggtgaagctagtgccccggacgagcgccatggcgtcgggggtgatgttgctgatgctcgggccgacgcggtcgatcgcgagcgggaatatcgcgctggcagggtgtcctgctccgtcccagacgcggagttcgatggtggctgtcgtgcccgtggtcatgtctggggtcagccggaattcgtcggggttggtggcgcgcaggacgccgttgacccaccattcggtgcggctgagtctcgacttgtcgttgaccacggcggtcagggtggcgtaggcgccgatcgttgtggtggtgccgggtttgagcgtgatctgcgggatgtagttgctgaggtgctcgatgaccggggggtcgttgtcgacgatgtatccggtgatgacgttgttggtgttgccggcccggtcggtcaggatgaagtacgggatttcggattgctcgctggcgtcccactggaaggtccaggggccttcggtgcggatgacgtcctggccggtgctgtagaagtgcattgcaatcttcgtgacgtcgtccgggacgtcggtcagcgtgatggtgaccggtccgctctccatcgcggtgccgtaggcgggcgaaggggtggcggtcggcaggctggagtccaggtgcacccgggtagtggcatcggtcgtgttgccggcggggtccttgacgcgcagggtgacgtcaaggtcggtgtcggtgggcagcgctttggcattgagtcggatagggccgtcccagttgacgggcatcgtcatgctcagtttgccgttgagcagcacctgcatctgggtggtgccgctgttgtcggacacgatcggcttgaagcccttgtaggcgccgacaagttgtcccggggtgagcccggtggaggtgatcaccggcggggtggtgtccgggaccggttcgtcggcgtgcgccggtgtggtggcggtcaggctgagtgagccgatgacgaccgcgatggtgcctttgcgtagtcgtgccatggtctttcctcgtctagcgtgcggtggcggcaccctacgcgcgtgaacaaatgaggctcacggctggctgccggttttgctctgtcgccggtggtgaggtgctgcggtgtgggaggcaagcgggtgtggcccgcccttggcggggcgggccacttggtgccggtgttatccgatggtggtggcgacggtggtcgtccagccgctgccgatctgggttttggtgccgagggtgccggcgccggtgccggggaagaggtaggcgttgccgttggcgtcgacgccgatgatgtcgggtttgccgtcgacgttgatgtcgatgacggcgtatctgaaggagccccagccggtgccgatctgcgtgcggcccgcggtgaacatctggtcacccgggttgccggtgttggggtagatgaacaggttgccgctggagtcgacggcgaccaggtcgtcgcggttgtcgttgttgaggtcgccggggaccatccggtacgtgctccatccgtggccgatgaccacccggcagcagccgttcgggtagtggtacagcgtgccgatggggtccttgccggaggggtcggtcgtggtcctgatgctgaagtggtccggatgcatgttggcgtccgcgttgccggtggagtggacgaatccgttccagccgacaccgagttggacgcggctgcggaatccggaggcgtggttgttggggtaccaccagaggatgccatcggtggtgtacccgaggaggtcggcgtagccgtcgaggtcccagtcggagatgtcccagcggtaggacgaccagccgacgccgatggagacgggggcggcgaaggtggaggtgccggtgctgcggttggcgtaaagccacatcttgccgtcggaaccgaccgtcacgacgtcgttgcggccgtcaccgttgaagtcgtggttgcccgcgaccgggtacttccacatcctgttccaggtctggacgaaggcgaccttgccgccgaagtatccggcggtggcggtgccggttccggaccggtgggcgccgatgcgcatcggcatcggcgtggtgttggagtctgccggggtccacttcacagtgtgggtgaagctggccatgtagacgctgttgacgtagaggattcctaggccggtggtggcgtcgtaggtgacggtgagctgtgaccaggcgttccacggtgcgctggcggggccggcagtggcggagtcccacgttgcggtagtggtgtcgccctggctcatggcgaagcgccaggatttgtcgctggggtcggcccacagtttgtaggcggcggtgttcttgccgtcctgggacaggacggtgccgccggtggtgggtttggcccagacgctgagggtgaagctggcgttggtcgggacgggcatcgacttggtggtcaggtagcccgtcttggtgtgcgcgtcagggccgttgagctcgacgtcggggctgaacaggtcgttcgtgtcccaggtggccccgtcggtggcgccggccgcgccggccgtggccccggatgcgtccaggtcgccgacgatgtccttagccgttgcggcgtcgacgttgccgctgttttggtcgttgagcagccaggcgtggttaccggtgaccagcgtctggggcgtctggttggcgacggcgcccgtagtgccggtcgtgctggtcacgccggtgaccaggtacgaagtgacggtcgctccggtgcccaacgcccacaggtcgggggtgccgtcgcggttgatgtcggcggcttgcaggctggtcgggacggttgcccacttggacacgtcagtgttgagggtgtacttcgtggcggtcagggtcttgggcccgttgtcgtattggacgttgcgccacagcgcgagagcgccggtgctgcggttccagaggaacatgtcggcgctgtcgtgccccgtcgtggggtcgtgggtcagcgtgccggccatggtccaatctttccagtcggtgccgccggccgggtttagcaggccggcaagggtgactgggttgccgaacgtgccgttgacgttctcgaagtagttcacgtggtaggtgccgtcggcggctttgctggtacccagcaggctcgcgaaaggactcgccgtgccgtcagcggcgacggtgttgagcgtcgctacctggttgggctcggtgccttggatggagctgaagtcgtccgggctgatttcctgcaggccggagatggtgccctgattcgagtcggacggttgtatcggggtgccgtctccgctgccggtgaggatggagccggtgccggtggccgggtctaccgcggggtccttctgcgtgtggtacgagatcacgtcttggctgccgtagccggtgaaccggccggtgatcacctgggtgccggtgtaggacttgggggtttggacggttgcctggccggtgccatagacgccgatgttggcggccacgggcatgacctgaccgttgttgttgccggcggcaagccacagacccggcgggaggttgttggtgccgccgacggtgaccaagtcagcgatgtcgtcaccgttgaagtcatcgggctgcgccggagtcgccgcgtaggcggtgacgggcagggaaccggtgtcaccgatgttgccaccgggcgacaagctggtcacggtgactacgttggagaaccgcgtcggcttgatctgcgcactgcctgcgccggtcgcgtccgcggtgaccttgtaaggcgcgccgccgttgacctggatgaggtagccgctgggcgtggtgccgttgctattgggcgtgatgaggatccgggagttcttgccctggaccggcgggaacgtgttgacgctggggtccgtgacggtggtgtcgaggacgacggtgggcgcgccagtgcgcgtcgggtcgtaccggaaggtgcaaggggccgaccacttcgaatagtggctggtgtcgctcgggctggcagggaagtcggttacccgaacccgccacgagaactgagtgatcagcttgttgctggcgccgtcgacatcggcggccttactcagcgtgtcctgaggaacgttgaggacggcgttgttcttgttgctggccgtcgagctcatcggggtggatgcgaccagcttggtcgagtcgccgtcgccggtggaggggaacagggacgcgtactgcgtcttgtacagctggaagccggcgcccagcgaagccgagccgcccgccgccgcgtccgggtcggtcacgtaggcatacaggctgagcggaccgttacccaccgccgaagccgggcttgcgttgcaagcggtgctggggctgcttgtcagcttcgtcggcacatccggcgtgtggttgtaggtgacggtcatcgacacggtcgacagcaggaagttcttccaggcccacttgtcggtttcgtcaccggctttgagcatgaacgtctggagggtctgcggattgctcccgttgacgtcggcgttgatggtcttggtgacatcgaagccgacggtgattggcttacagctggtgtcatacccgtgagcgaagctctgggtctgcacggctgccccgaggttgacgccatcccagtaggtccacttggcgttaccggaggtgagcttggtggtcggcgcatacagactgatcggtctggcgtcgcacgagtacgagtagttgttcgacatgttgagctctgccgagttgatcgtcgcgcctttgagcaccgagggcagcgcgaagttcagcagcgtacgggagacgatggtgtcgccggagtaccccacctgcaagaagccctggcggtccggggtggccttccaatagttgctgtccgcatgggatttggcgacggtcgcccaacccgacaaggtcgggctggccggcgtccactggaagtccggatcgatgtagagcgggtagtgcgtggtgctgtcctgcagcatgctgcccggcgtcagcgtgatgccggtgctcgtggccgtggtcggcagcggcgccacgttggcggcagctccgggtccgtccgggctggacgccgcccgggccgccccggcgttgcggctggtggtgctcggcgtgaccgccgagcgctgggtggtggtcgtcgcggctgtcgtggtggagtcccacatcagcggtgtgggagccgacagcacggtgcgtccggccgcgtccttgccggcgacgttgttggcggcgtcgctggccagcgtgataccgctcggatgggcggccaggacgagctttttcagcgccggattcgcggcggcagcggcgtcacggacgacgaacacctcagagaacccgccgtacaccgacgccgtcgcctggagattgacgccgggcaggacgtcggcgtaggtggcggtgtcaccagcgacagtaggcttaggcagcgtcatgggaacgctgagatcgaacccgaggccggctccggaaagcttcgcgagcgggctggtgccaccgccggagagcacgaccgggctcgtcgacacggcggggctcaggctgccgtcggggttggcggtcagcgtcgcgtcgagattcttccactggccaccgacgcgctggcggatcggtgcggccgtccgggtcatggtcagggtgccatcaggattcgcggtgagcaggtcggtcgccgtggtggcagcggtgacctcgaccttcgtaccggtcttccgcgcttgcgcgagagcttggtcggtagtcagcaggctggatgtcgtcttgctgacgttaccgacgtagccgacgtcaccgtcgggtgtcgccgcgaccgcaggcgacgacatcgaggtggcgacgagcgtcgccatcccagtgaccgcggcgagccaccgcgggcgtgaattcagcacacgcatgttgaagatttcttcctcgcaactaaaaggtgtcttatctcgccgccgtcggcaacgcgacccgtcacaggcctgccgaactgtaaacgcagctcgcatatgaggagaagccgacgaacggatcgatcaggccacagcaaattccagtgttgaatagctcacaccgggcgaccatttcgtccgtattcactaccgaaacagtccccgtttctggttgccatctcgtccatccgcccttcgggcaatcatcgtgaagtacttcttcgccgcggcgtcatggctgttcaggggagaaactgaggaaaacctgagagatgatccggttggccgcttacgtatgctttggcggatctctgcacttgcggctcgtgtctgcctgtctgcgccaatcgacgccacgctcgcagatttattccgccgatcgttattcatgcgtgatcatcaagcgggcgggttgcggcacaatctcgtgccgtgatctcgcggtttaccggtctgcataagcgccgttcaggcggctccccctcggcctattcgacggccgaggtttcggcgtatctgcaccgccgacaccgttcccggcggatggcggcagtcgcctccggacttgttctgacgctactggcctccgggcagggccaggctgtcgcggcgccctcgaccgcccccgcggcgaagacgaacccggctccggacgtcaagcccggacgtgccgtcaagggtgtctacgcgctgaagccggccaagcagccgcaccggcccgatccggccgagcagaagttcgtgccgaccgcgaccacgctgccgccggccggccatgccgcgatcacgatctccggcgctggcaagtcacacgccgcgggaagcgccgtttgggcgcagaccgtcgccgcggctaagactcgaatggcggccgcctccccggctgcggtcgacgtgcaggtgctcgaccagcagaccgcgaccaagctcgggatcaatggcgttgtcatgaccgccgcggcaccgaccgccggtaaggtccgtctcggcgtcgactacgccggcttcgcccaggccttcggcggcaactacggatcacggctgcacctggtccagctgcccgcctgtgcgctgaccaccccgcaggtggcggcgtgccgcaagcccgccgacctcggctcggccaacgacacggcatcgcagagcgtgtccgccgtagtcgatctgcctgccactccggcgacaccgcaggccgctcccggcgccagcacccgctccctggccccacagaaagccgcgaccacgcagcgcgccgctgtattcgccgcgaccgcggccaccggcggcgacggcggctcggccggtggctcttacgccgcgaccagcctgtccccgaccggcacctggtcggccgggagcagcaccggcgccttcacctataactacgcgttcaaggtgccgcccgccgcgaccggcatggctcccgaagtggcgctgggctacaactcgtcctcggtagacggcgagaccgtctccacgcaggcgcaggcggactgggccggtgacggctgggcgacgccgcagtcgttcatcgagcagagctttgtctcctgcgccgacgacccggagggcagcgcggcgccgaagaaaattgatgataggtgctacaacggtccggttttgacgatgtcgctcaacggtaactcgtcgtcgctggtctgggacgctaccaagaaggtctggaagtccgaggacgacaacggtgaggtgatcaccaaggtcaccgggtccaacaacggctccggcagctacgacacctcctactggaccgtcaccatgcgcaacggtgccgtgttccagttcggccgtaaccagctacctagctggacctccggcaagccgcgcaccaactccgtcgacaccgtcccagtctacgccgcacactccggcgacccctgctacaacgccaccttcgaccagtcctggtgcacgatggcgttccgctggaacctcgactacgccaccgacgcacacggcaacgcgatggcgtactactaccaccaggacaccaacacctacgcccgctaccagggcgccaccaagacctcgtacgtgcgcgacagctacgtcgaccacatcgactacggcttcaccgacggcaatgcctacggcaccgcacctaaccaggtcgtgttcaacaccggcgaccgctgcgtatccggcacctgtcagccgttgaactccacgaacaaggccaactggcccgacgtcccttacgacctgatctgcacctcgaccggcacctgcaacgtctggagcccatccttcttctccaccgtgcggctcgcttcggtcgtcacccagcagtactcgaccgccacctcgaagtacgaggcggtcgacacctggacgctggcgcacaccatgccggctaccggcgacagcacctccccgacgctgtggctgaactcgatcacccacaccggtaacgacaccagcgcccagccgaactcctcggcgatcaccgtgcccgccgtcaaattcgacagcatcaagctgcagaaccgggtcgacactgtctccgacggcctcccggcgttctaccggcagcgcatcagccagatcaccaccgaggccggatcgatcatcaccgccgactacagccgcaccaacgcatgcaccgccccggtaacgatcaccccgtcctcgaatacgtcgtcgtgctacccggtgcgctggaccccgccaagctacgtcgatccgatcaccgactggttcaacaaatacgtcgtcaccaagatcacccagagtgatccgaccggcagcgccgctgctcaggtcaccagctacagctacctgggtggtgccgcctggcactacgacgataacgagcttgtcgaggccaaatatcgcacttacggccagttccgcggttacggcaaggtgcaaacccgcaccggtgacctcacgaacgacaagcagacgctgtctgaggtcacctattaccgcggtatgagcaagaacaataacaccacgcctctgccattaactgattcccagggcggaagccatgaagatctcaacgagttggccggtaccacgctcgagtccaccatttatcgtggcgatggcggccccgtcgaatcgtcagaaatatcttcgtattgggtttctgacgctaccgcgacccggacccggactggcctttctgcgctgaccgcgaactgggtctcaaaagccgaaacgtttagccgtcagcgaatcgccagcggtgggacgccgacataccggtacacccagaccgataactcatacgatgccgacatcgcaagccttaccttcggttcgctgagacaaacctactcccacacggtgccggttgatgcgcagtacgatacctgtactacgaacacctacgctccggtcaacaagaccaagaacattgccggtctaatcgctgaaaccgaggtcgtgtctagggcgtgcggcggctacaccgccggcagcccgtcttcagcgcccggcacccttaaccgccttaccgccccggacagcgtcacccgccccgcacaggtggtttccgacgagcggtatttctacgacgaccccaccttctcaaccaccttcccgcaggccgtcgctccgactcgcggcacgcgcaccatggagcagcacgctaacggctggaacagcactggctatacatacaagacgactaacaagaccgagtacgacagctacggccgcactatcgctgcgtatgacggtaacggcaacaaaactacaaatgtatacaccaccaacgccgtcggcctcattaccagcaccactactaccaacgccctgaatcagaccgtggccaccaccaccctggacacgcggcgttctctgccattgacaatcaccgacgcaaataacgtcgtcaccaccctttggtacgacgcgctgggccgttccaaagcagtgtggctcaactctcgcaccaccgatctgccagcaaaccggctattcagttacaccctgtcgcagaccggaatctcgtcggcgaccacacagatcctgaacgacgtctcgcagtaccagctgtccacgctgatctacgacggcatgctgcgcccccggcaaacccagcagggaaccccgcgcggcggccggctggtcaccgacaccttctacgacagccgcggctggaccaaagcggtctacaacaactggtgggacgacaccaccacccccgacaccaacctggtctctgccgcgaacctcggtaagcaggtagccacccaaaccctgttcacctacgacggcctcggccgcgccgtgaaacaggaacaggccaaagacaacgtcgtacagaccggcgaaacgaccaccacggtctacgccggcgacgccaccaccgtcttcccggccaccggcggcaccgtcagcaccagctacaccgatccgctcggacgcacggtcaaaaccgacacctacaagacggtcccaaccctgaccacgccgagcaacaccttcaccggtgactacacctttaccggcggcacgaagatctcctcaacgttcggatacaacgaccaaggcctgcagaacagcatcaaggacaccgccggcaacacctggacgaccagctacaacctactcggccaggtcaccggcaaaaccgacccggacgcaggcacgtcaaccggcatgacctacgacggcaacggcaacctcacccaggccaccgactcgcgcggcaagaccatctcgtacacctacgacaaggccaaccgcaaaaccggcgtgtacgcggccaccgtcgcagcccaagccgccgcgaacaagctcgccgattgggtgtacgacaactccgacaacgccgtcaccggcatgaccaacccgatcggccagctcacctcgagtaccgcctactggggtgccaaccacgacgcctacaaaacccagcaacttggcttcaccatcttcggcacatccaagggcgtcaccgtcaccatcccgactgctgagggcacgcttgccggcagctacaccttcaacaaggcctacaccacgaccaccggcctacctctgcgtgacgtctacccagccgccggcggcctggcccaggaaatcgtcacctacggctactcgaccccttatgaccttctgaccagcagcgtcggcacgaacgcctacggcaagatcaccgtgttcgacgcctggagccgggtccagcaggaatccatcggttcctcacccacctacggctacgtcgtcaacaactgggacgcgcacactggccggctcaccaaccagaccgttagccgccaaaccggcaccccagccaccgtccactccacggactacacgtacgacccgatcggtgacatcaccaaactcgtcgaaacccggcaagggagcaccgccacctccgagacccagtgctaccgcgttgacggtttccgccgcctgcgcgccgcctggaccgccacggacagctgcgcggccgaacccaccagtaccagcaaagccacggtcggcgacgccctcggcgcctccagcgcctactggaccacctggaccttcaacgacctcggtgaccgcaccacccagactcagcacgccatcggcagcggcaacgacaccgtcaccaacttcacctacaacggcaacgccaaaaaccagccccacaccctgacctccaccgcggccaccaccggcaccaccacggtcaacaccgcttacacctatgacaccgccggcaacatggcgacccgggccgcgggcaagggcaaccagagcctgacgtgggatgacgccggacggctcaccgccatcaccggcagcaccgcgggcaacaccaacttcgtctacgacgccgacggcggcctactcctgcagaaagaccccggccagaccaccctgtacctgcccggcgaacagatcgccctcaacaccagcaccaaagccctcaccgcgacccggtattacacgctgcctggcggcggcagctgcatccgcaccggcagcacctacagcttcgccctcgccgaccacaacggcacacccacgctgtacctgaactccaccatgtccgcgccgacgtggcggcaatacaccccggacggtgcaacccgaggagcgggcggcgcgtaccccgacaaccgcggcttccttaacaagcctgtcaacaacagcacgggactcatccaaattggggcccggaattatgacccggctaccggtcgtttcatcagcgttgatccgctttttaatccagacgatcagcagtcatggaacgggtatgcctacgcggagagcaatcccgtagctttcagcgatccgtccggtcttcaggtcccgccggatgagcggatccctgggtggcagataagcggcgctccggcttggggaactagcggttttaacacaggcggcagcaacggcagtggcagcagtggcggcagtggcggaaagaagtcgacggcttcacttgatgaaaagacggcaaacggtctagaaaagatcagagctaagatagccaaaaagtatcaagtggcaacgatcgacgatctgcccgaggcgctacatgaatatgccctagaggacatcgagtccgaggcgtgcctgaaatacccgagtaggtgctacgacattctcagtgccatggcgagggatcaggtttttatcgcaaacccaggcgaaactaaggttgacggcccgtattcaaaatggaaagccgccaatgatgttgcacaagccactacagaggtcctagacgaagacccgaaacaggtcatggaaaaccatctcaaccctgaggagcgggctggcctgctaaggtcgatgaataacggcaagttctacaggttccgcatgttgtacggtcgcgctctacataaggcggtcgcagcgaaactgatgaagaggttccctggcgagtgggtatataaagaatcctggggtcccgatttgtttcacaagagcggagcggtcgtagaaattactaccgctggggagatgagtaatcatacaagtcgatcccaaagagagcatgaagcctatagggattatgaaggtgctgcctatgtgggctacgccaacgctccccttacgcagggagagatgttccgccttgcaggagaaatggcggcaggcaacgacaggtgagagcctcgcccgtgcactgcgcgtccaatattaattagcgatattgctttcttgggctcctgggctctctgcgaacttgccgcagagagcccaaccttgtaagcggcgcgattggatagttagaccgatatcacgcctcctttgcgctacaatgcatccgtgaacgataagatgctttggataagcggcgagaggttccagcgatatgacttcggcagccggaagctcgagtggctgtcagtgacttcgagtaagtttgatgactgctccttcaaaaacttgcgcgtaacgggcggtgcgctgggagagggtagcgtgcagagcgtcttctctgactgctcgtttgacggatctcatttctccggtgtgatgcttgggtatgttcgattcgagaattgcagcttcagggatgtgacggcgcagagttggatgtgtcacaacgtagatttcgtagactgcgtatttactgggcgactggacaaactaacggtgtttggttcctatgagggaatcgttaacgagataagtggcaatgatctaacaggcgcgacgatgcttggtggcggcttccgtgctggagtagacctgcggaagcagaagctgcctgctgacaaacggcatgtattgataccggaccctgaggcgttcctagtcagggcgatggctgcggtacaggaatggcctgatggggagatgcggcaattcgctgcgagctacctgacggtacttggtgaggatttcagaagcggccagaatgaattgctttactgtgcccgcgactcctctgccgctgcggcggaagctaatagtaggattcgtgctttaattgaatctggtgcgaaatagatgaactcggtgacgcggccgtgctcgcgagatgctagcggttggcggatgaggtgtcggcttggaatgaaatgggaccggtcgcacctggccggttccatccgcgagcaccagccctaccaaccacgaccggcagaacagcccctcgctgcttgacgaaacccataaggacacccccgccggtaagccggtgatcgccgccggctcaccggcgggttgccctccagctgcagatcacgcagatccgcgggaggaacgccatatcgcggagcgccgccttcaccgcatcggagctgccaaagccctcggtgagctgccggccgaccgtgaggcctacgatccgggcggcgccgtgagcgcgcagcattttcgcggtactcaccagggaggcccccgaagtccaggtgtcgtcgacaggcaggatcgccaaccccggcagccgggtggaggcgttaaaccgaaagtaggaggaatccacgacaccacgcgccggacgcccctccctggtcttcgacattaggttgaagatccatggcacgggccagtcgctgatgaggctggcggcggtcgggagcgggtcgaaggggcggtcgcctccccagctcgggacgtgggtcgcgaagtccaaggggccgaagcgggtttcgaggcagcgcaggtgccgcacgagaaggccacgggtcagcgctgccaggggcgcggccagccatcggtgatccgggccgaagttgttgtagcggtgcagcagggactccagtccgtccgcgaccgacgatccgatcggcacgtagccatccagcacgccgtcatagccgcggcaatgctgacatcgacgaaacgaaacgcccttagggttcagtcggacggccccgaaacagatgtcgcaccacccggccgcgcagatcggcgacggcttacggtccgccgcttcgcttattttttgagatctgcaagcgggccaactcggcaaccgccctaaggcgtgttttggaagctggtcatagccactcgccgatgatcacgatggtcagggcggcttggaaccggactgccagcttttcgtagcgggtggcgatgccccggtagcgcttgagtcgggcgatgctgttctcgacggcgtgacgcttgcggtagagggccttgtcgaacttcggcgggcgtccgccgcgggatcctttggccttgcggtgggcgtcctggtccttcttgctggggatgcaggcctttggtgcgagcgccggcggcgtgctgatgggcgcggctggtcatcgagtcgacgctgaccgtccagatgatcctgccgttggtatcggcggcggcctgcaatgccgcgaggatccggtcccaggtgccgtcacgctgccagcggcggaacaggccgtagaccgtctgccagggcgggtagacggcagggacgtcacgccacggggtgcccatccggattcgcccccggatcgcgtcgatgagctgccgtttgtcccacttcggcggacgaccggtcgtggacgcggcaggaagaagcggggccagcacggcccactgccggtcggtcagtcatgccgcctcgtcaccgctaaggtggccacgaggtctccggtatgaagttcttgcttggtcgcagaaccagataccggagacctcttcagttatcgatcaccgccacgccggaacatcgatcaaccgtcagcttctaaaacacgccttagacccttaggcgcgggcgcgggccgcagcagcctatggggtcgccccacccatctcggccgcacgccggggcctcggccggtcagcgtcgcgcatgccaccggcgtgatggcacctcgatgtctttactcaaggtgacggcgttcgtgggtggtccgtgggtgatcggatgtcggcgaccgttccagaactacggcggctaaaccagcacgatcgagtcgggcctgctggtcctggcggcctgcaattcggtgactcggccacgacctgccgaaacccgaacggcctctgagctggcaagacgactttggcacaaggttctttgaatgaggttacgaagcgtgctagtgcctactaggcgtctaactacggatctgaaggttagaagttcgagtcccttcgggcgcacttcttcgattgaggcctgagctgcggaaacgcggttcgggcctttctcgttgtccggccttgtagagaggttgggtggcgagtgggtggcacatgggtgtcatcactttccgcgactgaccgggttgcggcggctgcgtgacctgcggcttcgtttcttactggtgggccatttctccgaaggtgcttcttttccggcgcgcccggtgggccggttcttcgccgctttctccttgatgcgttggcgggtgtgccgggccgcggccagcaccaacgcggccgtcgcgtcggcgcagcggcgctgggagtcgggcaggacgctggtgtaggtgtcggcggtgaccacgatgctggagtgtccaagcaaatcctgcagcgtcttcagatccgcgcaggcctcgtgccagggaggcggcgccgtggcgcaggtcatgcagccggaccgggggtaggccggcgcggatggtgagcttgcggaaccgggtggtggcgtagctcaggttgatcggttcgccgtccttgcgggtgaagacgtagccggcggatgccagttcacggcggacgcgggcgcgtttacggtgggagcgaatatgggagcacaagctcgcctcagacggcgttgaacggtgctgaacagcgttgacctgccgggaatggcggcctgggtccgctggtcaacgcccaatccgctggtcagcgggtcgttggccgttccttgacacggaagaggtcactggttcgatcccagtatcgcccaccaaaggttttagcaggtcacatgctcgttaccggattctcggtaacgagcatttgccgttgtggtccttactgggagagcgcaggatcggatagaggctgcccgcgcatcgggtccacccgatgacgttttttccatacggctgcaccaggcctcgcccggctgaggtcccgacctcgacagatcggatcagtggagatctgtcccgatcgcgtcacgcagctcagccacaacctgttccggttcggcgaggcagcgccatgccggtacccgcttgactgttgcggcggaggcgatgatgtccaggcggctcagcacccttcgtagcgagtggccgtccggatcgccgtcggggtcgtcgaccagcacggccagccgcttgtcgccgaggctgatcgtgaagtcgacggggtaacccggcagcggcgtttcccaatgcactgtcagtccggtctcgcgaaggccggcgatcagccgatcggccggtcgtgggccgacatcggtacctgctgctgtcgtgcgggtagggctggcgagatcggccagcagaccgcgttgtccggaccaccatgaccggtcaccggcgacgatgagttgggagcgggcgcgggtgatcgccacgttccacaggttggtctggttgacgagccagccgcgggtgcgttcgctgatgccctgggcgccgaccggcgagacgaccatgatgtccttctcgctgccctggaacttgtggatggtcgcgcagagcaggttgtcggtgagcccctggtcgaggagggcgcgctggagatggcgctgctgttcggccaggggagtcacgacgccgatcgaggcttccggatactccttgcgcacccgctgcacctcggtcaccacggcctggatctcgtcggcgttccggcccgatccggtggcgcccttggtgaagtggccgggcacgtcgacccagcgggtggcgggttcggccggtgcggcgagccgacccgggtcggtcagtacggtcagccggttctggtagaccacccggttcggggcatcgatgatctccgggtggcagcggtagtgttcgtcgagcaggatggtgcttcccgctgcggcggcgaatgcctcgtacgccgaatggtcgcggtaggtcagtcgccgattcgtcagccagccgtgaccgagtcccgcacgggcctgctccctgcggtcgtcgtcggcggagagctcgacgaccggggtcagctgccgtgggtcgccgatgatgagggcgcgttctgctcggtagagcatcggcaggatgtccgcgacggtgcactgggctgcctcgtcgatgatcaccaggtcgaacaggccggcccggggttgcagtcggcgggccgacttcgcggtgaccgcccacccggggagcgccttgacgagggccgacatgtaggtccagctgctcccgttcggcttggccatctcgtcggcgcgattgcggagcagggtggtgtttccgctgacccgcgtggcgatctgggcgcgcagaagctccttgctgtgctcggctctggtgtcgtgctgcaaggtccgtaagcgctgccatgcgtcctcaacggcgtgtggcagtgccacgagttgccgctgtcgttcacgccagcattgctcgatgaccgcactctcgccgaggacggtgatcgcatcgcggtcgaaggccccggatgaccgtagccgtctgcggtaccaccatccgaaccagcggctccgtagcgcccgttcggtgaggtcgaccagcttggccagggtgcgctcatccgtgtcggtgagtgtcgcgtcgcgtgcgaaggcaaggtcggcgagatctcgttcgagccggcgatggtgatcgagttcttcccgcagctgttcgatctcgtgtgccacgagacgaagctcgtggaacgggccgcgcgtgtccgccgctggtggcggccacgcctgcatcacctcggcgaggtactgcggttcctgctgccggtagtccttgttcccggtacgcaggatcaggccggagccgaccatggcggtgacccgctcgaccacctcgtcgacggcccggttgttcgtcgagccgatcagcacgctctgcccggccgccgtggcagtggccagcaaggcggtgaccaactggctcttaccggtaccgggcggtccctgcgcaaccgtcaacggcctgctcatcgcagcccggatgatctcctcctgggtctcgttcaccgagctcggcgccaccgtcagcacgtcggccgcaggttcgacccgcgggtcgtcgttcgcgttcgacagcgcgccgagagcggtcgacgcgatcttcccggcgttcttgacgatctcctgcaggtcctcgatcagttgtcgatcgggggactcggtgcttccggcggcgaacagcatcccggcgttctgcacgcggttgagtggtcctcggtcaaccctgccggccaggttctgcggatcgagtggcgaggccggcttgaggccgaacgccttggcgaccaggttcacggcgtcggcgagggatcggcgatcgccgggaacgagtcgttccgctacggcctcgcgcaactcgtcggcctcgaccacggacaactggaagtggtcgacgagggcgggactgggttgcggcggtgcgggatgagccaacccgtcggcgcctacggtcagatcgcagacgagcaacggcgcccaatggagctgctgccggcccttcggggacagcgtcaccaccgggtagccgtactgcagggatcggccaccagcctccgccgccttggcgagttgttgtcctcgttctccgaagcggaccggttcactggccgagaacacgacctcacggccggcgggggcggggacatacgagtcacccgctaccggatccacgaagaactgaagaacggcggaacgctgcaggcagttgacgtagtagccgagcagccgccgccaccgctccgtgtcgaacggtgcatcgtccggctcctcagccggtttgccgggtacgtgtcgccggcgctcgacagatccgctgaccagagggatcggctcagtgacaccctcgctcgactcgaccggcttctcctctcggcggcggcgcgacatctccgtcatcgcgtaccgagagaggtcgctcgccgtgatccagccgtcttcagcggtgccttgggccgcgccgcggagaccggtgagcagcacctcggtgaaaagcgaaggccgatccggaccttgcgccttcgaggccttcagatggctgctcgactgcagcaggaacgtgccgcgttcccgcttgagccgacggggctcctgccgcacgccgccggtgaaccgatgccgcgccgtgaacgaccccgagaagcagcagtccagaagaaccaccttctggccggccttggtgtcgttcagcatatggcgcaggatgccttcgacatcgaacgcagtggtgtggaggatcgacgtgtcggtgtcgatcgtcccgaggaacagagactgccggtcgccgtgcagaaccccgtggccggagtagtagaacagtgcgagatcgccggcgagccgggcaccgtagaactcctcgacgagctgtttcatctgcactgcgggaagatcgatgcgcgccgtgacgctgtcgaactcgccatcggtctccagcagggtctgcagttgctcgacgtcctgccggacaccgggcagcggggtcagcttccgatcagcgtgataggtcgccgtccccagtatcagggcgtgccgacccatcagcgggaacgctcgatcgcatcacgaacaatgtcgatcatcttggccgtctccgccttggtcgcctgatcgatcgtgaactcgacgtccccgatccgcagatgggcccggcgaccctgattacggtggagaaagcccaccacgaggtcgacgagcgcctgtgcgtagcccggatcggtgccggcgaccgcggcgacggcggcaagcacgacctcgccgacgcccttcccgtcgggaacagcgggcgcttcgagccgactcacctcgcctatgtcgcgcaggtcctcttcgagttcttcggtcagctggtcgagaacgaagtcgtcgtcctccggcaacggcgtgaaactgacctcgatgaagacctcggacactatgcctcccgcagaacccgactcaaaagcatccgaaacgctacggattgttagagcggcacagttaaatatgtcgggttcccgacatgatggtgattgccggcgatcggggtcgggtgcggtcatgaactgcgcgcgccacgctgacctggctggatgccggcgtcccgcccgcaggaccgtcgccggccggtcggtacggcggcgggggctgtcgccgtaccgaccggttgccggtttgggctagctagctaggggcggccgtggacatggcggacggcgtagctccgggagtgcccgcgagcgcggccccggccggggcggtggtggtcgtggtgatgcgcgctgtcgctgatgcgctcggccggcccgcggccgtacccgccgcgtggttgtctccccgggggccacacgcgccgatgaaaagcgtcagggaaatggccgcgatgaaaccggctagtgctgtccgaacccgagtggactcacctcggtcgcgatgcaatgacatggattctcgtcccattcttggtgtaccggcaaggggggagaataggtccgcgaaggccaatagggaaccgctgaaaactcacatcaagtttgtgatatctcagctcatgccgtgactcgcgcgggggtggccgtccctatccagcctcggcggtggcctttcggtgattcaccgggtacggtttcggcggccggacaaagctgtgcgaggtaatgatgacatcgacggacgatcgcgtattgaatgcggcaatgggtggtgatcgccgggctcgggaggacctgttccggcgacagttgccggtgatctactccgcggtcgcccggctggttcccgcggaacgtgtcgacgatgtcgtgcaggagaccgcgacccgggcgatcgaacacctcgacgagctccgggacacgtcccgcctgcgttcctggctgctgaccatcgcgctgcacgaggcgcggcgagaccgggcggcgcgctcggtggcacccgactggcgccttccggagcccggccccgatatcgatccacaggatgtggcggtcgcccgcgtgacgatgtccggtcagcggcgggaactggccgccgcgaccgcctggctggatccggacgaccgggagctgctcacgctctggtggctggagacgctgggagagatggaccggccggcggtggcctcgacgctcgagcaggaggccgcctacgtggccgtgcggttgcagcggctgcgggagcggctcatgaaggcgcgcgtcctcgtccgcgtactggccggcacggattcctgcccggagctggcggcggagtcgtccgggtgggacggcgagccttccgcgctctggcgcaagcgtttcctgcgtcacgtctcgtcgtgtggccgatgcggcgcggcgggcggcgccctgattccgccggagcggctgctgcccgccttcccgctgctggtgccggcgccggcgtttgccgcagtgtcgtccgcggccgccggagctccggcgaaggccgccggaacgcaggtgaagacggtcgtacgagcggtgcgccggttgcagtcgctgggtggcaacactgccgccgcggtggtggccacggtggcggtcgccgcggcgtcgatcggcgtttacgctgtccgggcgcatcgacccgaccccgccccggcggccgcggtggagccggcggctcccggctcgccggccggacgggccccgagcgcggcccccgcatcgtcggcaccggcgccggcccgggcctccgtcactctagctagctagccaaaaccggcaaccggcggtgctccgaacgaacagctgtcgggccggacgcccacccgggcgtccggcccgatcggtatcgtgcttccctgcgctctacaggttgtcgatgcgggccaggagctcttcctcggaaaggttctccaggaccgcgtcctgcttgcggcccaggatcgccagcagcttctccttctccagcttcttggcggccgccgccttcgccgcctggtcctccgcgaggcggaccgcgatgacgtgtttgaccacctccagcttggcctcccaggtggccttggccgggttgccgtcggtggctacgaaggactcggtgtcgacggccttgagctcggcgttgacggccctggccacgtcgtcgaggctgaaaccggacttggcggtcagcggcaggtcccacagctgttcggtgctgagcaggcccttggccgacgggtagcggaacttctcccgcgtggccttctcgaaaacggtcacgatcgtcccttcggggtatggggcgtcagaactggatgctgatgaggcggcgccggccgccggtcatggtgaccttggcgaccaccgcgttgcggaccgtggagctgaagccgaggccggacagctgatcctgcgccggctcacacttggtgcggtcgccgagcacctcgaacaccttgcggtgcgccagcagatcgtcgcggaggaactcgttgtagatgccccgggtcggctggtcgttcacgcacccctgcaggatgaagaagtagtggcggttgccgacctcgttgccgtcgaagtggttcggcgagtacatgatggtggaaaccggcacgaactgttcggtggtgatgccccacacctcccggccggcgctgcccagccgcatgtcctcgcccggccggaaggcggtgatcacctcgtcggtgaccgtcatccggcccacctcgacggtctccttctggccgaccgcccggtcgtggcgatagtgctcgatccgcccgttgctctcggtctcgatgacgaagccgacccgggtgctctcccgcttgcggaactggttcacctcgatccggtactccccgtccgggacggtgccggtccaggtgacgttctccaccggctcgcgggagaacgccccgccggcgttcatgtcgacgtccagcttgttgcgcttgtcctggtaccagatgtggtcgccgttgggttcgaacacgtgcaggtcgaggtcgtcgtggttgaaccaggacaggctcacccgcagcttgccggtgacgttcccgccggcccgcttgaccctctccctgatcgagtcggtcacattgccgccgtacgaccaggcgaaatcgttgtcccaccggaacagccgcggggcgtccgggtgccggcccgtggtgagactgaccaggtgtggctcgtggctgtcggcgacccacaggtcgatggccgcggcaccgggcatgatgtccttcaggaagacggccaccgggacctcctccggcttcgcgtcccgcgggcgcgccgctgccgacccggtggtggccgcctgcatgagcagcccctcgatgccgtccttcatccgcgactgcgtgtcgttgtcgacccacagcacattggtgaccgacacgtcggacagccgggcgaaccgccgctgcaacgactcctcgacacccagctcgtcgatcgtcttcatggcggcctgcaccatggccggggtgatcaacgcggtgggacgctggtagttctgcggtgccaccttcgtctcgaacgaccggaccgcgtgctccggatcgacacccgcggacagatcctggaccagggtgccgatcaccgtgttgcggaaccgggccgccgggttcaccgcgttggcgaagacgaaggcccgtcggtccgtcgcctgcgtccacctgttccgcagcgaccggaactcggtcaccgcccggcggtgctccgcgccacggtagagggcgttgtcgtcgatcaggtcgacgacggtgtccagggcgggcgtggtcagctcggccagaccacgctggaacacctgcaccgccgcgtcgaagacgccccgggccgcgccgatgtcctcggcgcgatgccgcttctccaccctgccgtgcaggtggtcccacacctcgacccggccgtcgcgcagcgcccgggtggtcttcgtcccgtaccgcgcctgggtcgaccggaagatggtggacagcggcagcgtgccgacgaactcgtccatcgcggcggcgacgaccgagaacaccgggtcggacgcggacaccccggaccacaccgagcgcacctgtccgtcgcggatctcgacgacgtttccgaagttcttcacgaacacgcggcaggtcgaacagtcgtactcggaccgctcccggaaacggacattggtgccggccggaaaggcgtcgagaaaggtgagccagagcgaatcccggtcgagcccgtcgccgacgacgaacagctcgtccttggacatcgtggacagacgggcgctcacatccgtcacgaactgctggaaaccgtccaccgtgtcatccccctcgatcaccgccgatcctagggagcccgcctcgccggagaaacgcatttccgatccggcagggatctacggtggcaccgtgacgttgaccggtgaacttgtggccgcggttgccgcggaactccgcgacctcggcgtggtccgcggaaagcaccaggcgctgatggtgcgcggcgagcgtggcgacacggtgctggtgaagctggaacgccatgccagcccgccgcggatggaggagttcgtcgtcgacatctcctctgcccttccacgacctcatgtgccggatcgaggacctgagcaccacggatctgcgggatctcacccgcttcttccggtcgcgctctgacgatcccagcctggctcagctggcggactggatcgagaagcacttccagtgaccgctccggagcaccccggagatgccggtgcctgggcgaacggagcgccctgaacagcctgaacgccgcgccgcctacctgttcgagcaggcgaccggccggaccctgtgcaccctcagcgataggcggcgtgaccggtgagggcctggccgatgaccagggtgtggatctccgaggtgccctcgtaggtcagcaccgactccaggttgttggcgtgccgcagcggtgagtattcgagggtgatgccgctgccgccgaggatggtgcggcactcgcgggcgacggccagcgccttgcggacgttgttgagtttgccgacgctgacctggtgcggcttcagggtgccggcgtccttgagccggcccaggtgcagggcgagcagcgcaccggtgttcacgtcgaccgccatgttggcgagtttctcctgggtgagctggaaggccgcgatcggccggtcgaactgcacccggctgccggcgtagtcgagcgccacctgcagcgcgtcgcgggcggcgccgaccgcgccgaagatgatgccgaaccgggcctcgttcagacagctgagcggggcgccgaggctgcgggctccgggcagccgggcggagtcgggcagccggacctcgtcgaggatcagctcgccggtgatcgacgcccgcagggacagcttctgcttgatggtgcggctggtgaagccgggggtgccgcgcggcaccaggaagccgcggatgccgtcctcggtctgcgcccagaccgtggcgatgtcggcgatgctgccgttggtgatccacatcttggtgccggtgaggatccagtcgtcgccgtcgcggaccgcccgggtgcgcatgttggccgggtcgctgccgaagtcgggctcggtcaggccgaagcagccgatcgcctcgccggccgccatccgcgggagccactcctgcttctgctccggcgacccgtatctccagatggagaacatcgccagggagccctgcacggagacgaagctgcgcagccccgagtcgccggcctccagctccaggcaggccaggccgtacgccacggcgctggtcccggcacacccgtagccctccaggtgcatcccgagcacaccgagtctgcccagctcgggcgcgagctcgcgggggaaggtgccggcctcgaaccactccgcgacgtgtgggcgcacccggtcggcgacgaaccggcggacggtctcctggatctgccgttcctcgtcgctgagcagtccggcgacgtcgagcagttccagcgggtcggtgagggccatgcgtcctccaaggtttcggcgcacccgattcagcgatggtacggccgcccccggctcactacggtgaggccttggacaaaaggggagtcacgatggccgagctcgatgcgctcgaccggctgggccccggtgatcacgcctgcctcgtcttcgacgacgagtccgtgtgggcccgcggtgtggcgtcgttcatccggtccgggctgcgtcggcatctgcggatcatgtattgcgggcgggacgccgaccggctgccggccatcctcggcggcctgggcctgaacgtcggcgcggcgctggaatccggtcagctcgccctggcgggggtggacacggcgtacctccgcaagggggtcttcgatccggaagcgagcctgctggcctgggcggcgcaggtcgccgccgcccgcgcggccggctatcgcgggatggtcgggatcggcgacatgtcgtgggcgtgccggtacgccggcatcgagcagctcgcctggtacgaggcgcaggtgaaccggatctgcgtggacggtttcacgatgggcgtgtgcctctacgaccggcggctgttcagcgagccggacctgcgccgggtgacccgcacccatccggcgccgctgctgcgggcggtgcgcaccagcgagccgcgcggcctgcgggtcgccggggaggcggacctgtcgaaccggcaggcgctgcgcgcggtggtcgagcatctgatcgaggacaccgcggccggcccggaaccggtcaccctggatctgagcgacctgcggttcgccgactcggccgccgcccggatcctgctcaccccggcccgcgggaccccgctgcgggtcaccggggtgagcggcccgctgcgccggctgctggacttccactggtccggaccgcccgaggacctgcgaatcgagtagaacactccacttctcttccggtgtgccgatggtgcctgttggcaggactgtgccccgcgggggcaccggaggatcagcggaggagtgggatgcgcggccaaccgtctgaccgtcgcatggacgagggcttcacgctgctcgaggtgctcgtggcgctggccgtgatcagtgccgcgatggccggtctgggcgcattcttcgtcaacggtgcgctcaccgtcgctcagcagcgtgatcaacgctacgccgcacggctcgccagcagcgcgctcgagcaggtccgcgccctggaaggctcggcgctgctcgacgggcgcggtcaggcgaaggttgaccagcagtgggcggaggtgcagagcgggccgttcgcgagcatgatgcagccgtacctgtcgcacatgctgaagctgggcatcccgaacagcaccgagggcgacaacgcggcgctgccgaccgtgcccaagccggtcaccgtcggcaccaccagctaccagcagagcatcttcgtcggcccgtgcgaggtctacgtgacccgcgacgacgactgtgtcgtgccgctcccgctgaccgacccgaaccgtcccaccgacgccacctcgatcctgtcgtactaccgcgtggtggtgctggagacctggcggcacaagacctgcacggcgcccggcaaccagtgcggctatgtcgcctcgacgctggtctccagcaagaaggacgacgccaagttcagttccacccgggcgatcccgaagatccgccagcccgacatgaaggtcttctaccgcaacctcaacaaggtctcggtcaagatgaaggtgaccggcggcaacctgccgaacacctggagcgcggtcaacctgcccgacgggctcagcatcgacccgcagaccggcatggtcggcggcacccccaccaagctgggcacctggtccaacgccaccaccggcacctacgtcagggtggtggagaacgcgccgccgaccggcacgctgtccccgcgctcggacaacgacaaggcgctcggcctgacctggaaggtgatcgacccgccggtcgccaggtcgcccgccacgtggagctacgccggcgccgcgatcagcatcgcgccggtcgtggtggacacctcggtgccctacacgtactcgatctccggcctgcccgccgagctgtcgttcgacccggccaccggggtgatcaccgggacgccggcgcagaccttcagcgccaccgtcacggccgtcaccaccgcgaactacgtcgcgatcgacgtgccgttcgcacacacggtggtccagccgctgaccctgcagccgatcaccgaccagacggtcgacctggtgtcgacggtcagcgtgcccgcggtcgccgccggcggtgacggaaagtacacgttcaccgcgaccggcctgccggtggagctgagcatcaacgccaccaccggcgtgatctccggcggcccggtgctcatcgccggccggtacctgccgacggtcacggtgaaggacgggctcggtgggtcggtgagcgtcagcttcgtgatgcaggtgggctcgccgtcgaccaccctgatgttcaccgctccggcggccgtgcagacctccagcgccggtaaggcggtgacgataccgatcaccaccaacgccgacgcgctcaatgtgaagggcgtcaaggtcaccgccaccgggctgccgacgggtgtctcggtggacaagaagggcgagaacctcaccggcaccccgctgctgcccggcgtctacaccgtcacgctgaccggtaccccgtcgggcaaggacgcgcaggtcacgcagtacacgttcgtctggacgatcctgtgaacacccggaaggggggcggcgtgccgccgtggaagcgccgtccggccgacgatgacgatcagggcttctcgctgatggaggtcctggtcaccaccgggatcatgtcggtggtgacgatcgtcgcggtgaccgccctgctgcagatctactccggcacccggcagatcgaacagaactcggtcgccggtgaccagctggacatcagctatgtccggctggaccgggagctgcactacgcgacgtacgtgtacggcccgaccccgggggcgaccaactcccggtcgtacctggagttcgcggttccgccccggcagaagctcctgacggacaccgtcgacccgcccgtccgctgccggcaactgatgttcgacccggtcaagaagacgttgacgatggccacctgggacctgcccggcaccacgccgggcaccccggccacgctcgccaccgacgtggtgctcgacgccggcgccacgaccccgttcgccgtcgtcaagccgggggacacgccgttcgtcaccgcgagcgccgggacggtcggggtgggtccgcagttcaacgccaactatctgatggtccggatccggttccaggcgaaggtcggcgacgccgtccagcgtttcgacaactcgttcacctcgcagaacatcaccgatgagaacgacggtgacacgtccgccgacccggtgccggacccggacaggaactgcagcaacgtagggaggccgtagccatgatgacgcttcaccggtccggcgacgacgatcgcggatcgctgcccatcgcgatgatggtggtgctgaccggcctggtcctctcggtcgcggtccttccgatgatcgtccggcaggtcagcggggaacggtcgatttcggaccgcaacaccgccctggccggggcccgcatcggcctggacgtggtgatggcccggatcgcgtcggccagcatgaagatcgccgcgtccgacccctcggccgtcggcctcctggaggatctgccggactgcaggaatccggtcgagggtgacgtcggcgtgggccaggagaagctcaagtattcggtgacgatcgcctacaaggactccgagggcacctcgctcacctgtccgctcaccaaggtcccgaagaccgcggagctcaaatccaccggtgcgggctcgctgaacgtcgccccgatcggcaagcccgcccagtacggctcccgcgtcctgaacgcctcctacacgttcgcgctggacaacgacaaccagaaggcggtcggcggctccatccggatcgacacctcgacggtcggcaacctctgcatggacgcggtgtcgaagaccccggcggcgggcgcgccggtgaaggcgcggctctgcgacggcagcagcacccagcagttccagtacaccgaagagctctacctcaagctggtgaactcggagaccgacgcctacccgaacggcatgtgcgtgttcggcaccacggcgcacgccaacggcaaggcggtcgtgctgcagccctgcccgagcggcagcatcgtggccgacttccagtggagcctggacaacaacagcgagctgaagtcgaccagcccgacccggacggtggagaacttctgcatcaacctcaccaccggcagcaaggtggacaccccgctggtgctgaactcctgcagcagcaactcgtcgctgaacgtctggcgcttcgacgccggggtgggcgccggcatggccggggaggagacctaccagctggtcaactactcccagttcagccgctgcctggacgtgaccagtcggtcggtcacctcgacgtacatgatcgcgtggttctgcaagcaggacccgaacggtgtcgtggactggaaccagacctggtaccacccggtgccggtggctccggcggtcgagaagcagggcgtcatctacgtgatctcgagcggcaagcggtactgcctgaagtcgccgctggtggccaccaccagcagctgggtgacggtgaccgcgaccggctgcccgcagaccaccgtgaccagcaacgtcgggatccccgccgaactgctgtggaacgtacgccgggccaccggcagctacaccaccagctaccggatcgaggatgccaagggcctgtgcctgcagcccaccgacctcgccaccggggtcaagaacgtggatctccacgcggacggcaccagcaaggtgaaggtggccgtctgcagcagcgccgagctgcagaagtggaacgctccgccggacatcagcaactccagtccgctgaccggcgtcaaggagaactgagagcggggccggggcacaccgatgccccggcctccgcgcccgggcggctgaaccggtcaggaaacgagaagccggccggctccggccgccactagcctttccaccatggagaccacgcaccccgccgacagccacgacctcatccgcgtgcacggcgcgcgggtcaacaacctcaaggacgtcagcgtcgagatcccgaaacgccggctcaccgtcttcaccggggtgtccggctcgggcaagagctccctggtcttcggcaccatcgcggccgagtcccagcggatgatcaacgagacgtacagcgcgttcgtgcagggcttcatgcccgcgctggcccggcccgaggtggacgtgctggacgggctgaccacggcgatcctggtcgaccaggagcggatgggcgccgacccgcgctccacggtcggtaccgccaccgacgccaacgccatgctgcggatcctgttcagccggctcggcgacccgcacatcggctccccgcaggcgtactcgttcaacgtcgcctcgatctccggcgccggcgcggtcaccatggcgaagggcggggtcaccaccagggaacgccgcagcttcagcatcaccggcggaatgtgcccgcggtgcgagggccgcggcgcggtcaccgacttcgacctgaccgcgctgtacgacgacagcaagtcgctgaacgagggcgcgctgaccatccccgggtacagcatggacggctggttcgggcggatcttccggggctgcggatacttcgacccggacaagccgatcagcgaatacaccaagcgggagttgaccgacctgctccaccgcgagccgacgaagatcaaggtcgacgggatcaacctgaccttcaccgggctcatcccgtccatccagaagtcgttcctggccaaggaccgggaagcgatgcagccgcacatccgggccttcgtcgaccgggcgatcacgttcaccacctgccccgactgcgatggcacccggctcaacgagggcgcccgcgcgtcgaagatccgcggggtgaacatcgccgacgcgtgccggatgcagatcagcgacctggccgcctgggtgcgcgacctcgacgagccgtcggtcgccccactgctcggcaaactccggcacaccctcgactcgttcatcgagatcggcctcggctacctgtccctggaccggccggccggcaccctgtccggcggtgaggcgcagcgcaccaagatgatccgccacctgggctcgtcgctcaccgacgtgacgtacgtcttcgacgagcccacgatcggtctgcacccgcacgacatccagcggatgaacgacctgctgcggcaactgcgcgacaagggcaacacggtcctggtggtggaacacaagccggaggcgatcgcgatcgccgaccacgtggtcgacctcgggccgctggccggggcgggcggcggcgaagtcgtctaccagggcaccctcgaagggctgcgggccagcgggaccctgaccgggcggcacctcgacgaccgggcggcggtgaagaacgacgtccgcaagccgtccggatttctggaggtgcgcggagcggaccggcacaatctgcgcggtgtcgacgtcgacatcccgatgggtgtgctggtcgtcgtcaccggcgtcgccgggtcgggcaagagcagcctgatccacggctcggtggccgggcgggacggggtggtcaccgtcgatcagggcgcgatccgcgggtcgcggcgcagcaacccggcgacgtacaccggtctgctcgaaccgatccgcaaacagttcgccaaggtcaacggcgtgaagccggcgctgttcagcgccaactccgaaggcgcctgcccgaactgcaacggcaacggggtgatctacaccgatctggggatgatggccggggtggcgaccacctgcgaggtgtgcgaggggcggcggttcgacgcgtcggtgctcgactaccgcgtcgcggggaagaacatcagcgaggtgctggcgatgccggtggccgaggcggtggagttcttcgcggcgggggacgggcggaatccggcggcgcaccggatcctggcgcggcttctcgacgtggggctgggatatctgacgctggggcagccgctgtcgaccctctccggtggggagcggcagcgggtgaaactggccgtgcacatgggggagccgggcggggtgttcatcctcgacgagccgaccaccgggctgcacctcgccgacgtggaacaactgctgggactgctcgaccggctggtggacgcgggacggtcggtgatcgtgatcgagcatcaccaggcggtgatggcgcacgccgactggatcatcgatctggggccgggcgcgggacatgacggcggactcgtcgtcttcgagggcacgccggcggagttggtggccgggcggtcgacgctgaccggtgagcacctggcggcctacgtgcgggcgtaggtcatcatgtgccgatgcgccgttacctgctgattctcgccctggggctggtctgcctgacctccgcggacaccgtcggggtgcggctggtggcgtggccggccccggcgcgcagctcggggccgctggtggcgcacccggggtggacctcgtgcgccggggtcgatgcgtccgacgagtcggcgctggcgctgccgctgctggacgacacgttcaccccggtggcggcggtctcctgcgccgtcggcccggaccgtaccgctgtgccgggcggtgccggtgcgcttgccgtggtgctccaggagcggcggttcgaggacgtcggcacgctggtggccgcactccgccagccggatcggaccgccgtgcgctccgatgcgctggtcgacggcgacctcttgtgcacgctggagaaacggcctgtcccgtgggtcgcggtgatcgacgcgcacgggcgctgggtgcaccccggactgcccgtggaggcgtgcgggcaggtgtcccaccgcctgctcgatctgatccgggccatgcccgccacacgggtggtgacgacgccactgcattgaccgtcgccgctctgttggggaggggtgtctgaccggcgggaaagcgttgtccggatgggccgtcccggcggccggacggatcttgcgggcgccggtgtcgggtctctagcgtcgtccagtccgggaaaagatcaggaaagacaccggccagtgacccgggagggttcttgatgcgcgacgacgcgttccgcgcgtacttcgaaaagcatcatgcttcgctgtcccggctcgcctacctgatgaccggggagacggcggtcgccgacgatctcgccgcggacgcgctcaccgaggtctggcggcactgggaccgggtgcaggccgccgacgatccggtcgcctacgggcacgggatcctgatgaacctggcccgccagtgggtccgccgccgtggccgggaacgactgatcgccctcgggctgtccgggcgggccacggccggcagcgacgtgcccgcggtgctcgacgtgcgcagcgccctgcgcaaactgccgcaccgccgccgggcatgcgtagtcttgcggtacgcgttcgacctgtccgagcgcgaagtcgccacgacgctgggcatctccgtcggcgcggtgaaaagcgccacctctcggggtgcgaaacagttggccggcctgctgggcgggacggtcacccggatcgacggctgggaggcggcccgatgaggccctcggacgagcaccacgacggtccggcgcgcccccgtgccccgcgctccggcgacgcgccgcccaccgacgatcgactgcgggcggtgctgcgcgcggaggccgcggcgcaccggcccgaccgggaggcgatgctggcccgggtcaccacctcggtgatgagcgagccgatggcccgccgccggggcgggtcccggctgcggctggccctggtcggcgcgctggtcgcggtcttcggcggcggcggggtcgcggcgcagtgggcgctgaccggcgacggcgaccggaacgacgcgacgccggtcgtcaccgtcacggccaccacgcccgcgacgactccggctacgccgccgcccgccaccggccgtccggcgcccagctcggcggtcccgtccggcaccccgccgacgtcctcgaagccggccgttgtgggcgccccggcgaccagcccggccgccgtccggagccggcccgggaacacccgcgtcgagcaggggccgctctggtcggacggctccgtcgacgccggcggtgggtcgagcgtggtcaccctgaggaccggggagagaatcaccgcgctcaccgtcacgatccggctcgtcaagacgcccgggctggtctcgcgcggtggcaccaagtcggtgcccggcgccagcgtcaccacgaaggtcgaggaccggggtgacgcgttgctctacacgttcaccctgtcttcggccgaccgggtggcaccggggacgtacacgttcaccgcgaagtacgtgcacgccgacggcggccgggacgccggtggcgacacctacgaggcggtggcgacgaccgcgggcgggcagtccctcgacgtctacggcgacttctatccggcggggtgacctgctcccctgcggaggatgagaagtcacccggcgggcgcccacgatggcacgatgaggatgcgtaccggcgtgagttccgtcctggtcccggtgtgcggtgccggtgttctggtgggctgtggccggtcggcgtcgccgcgcccggcagcgtcgagcccggcccgcgcgggagcatgcgagccgcaccccggcggacgcgcgtacaaaagacttcgcccttaatggggaaccggaaccggagccacccgccagatgcgggctgcgtagtcggccaccgtccggtccgaggagaagaagccgctgcgcgccgtgttcagaatcgacagccgggtccagcgccgcggatcccgccaggcccgctccacctcctcctgcgcgtccagataggaccggtaatcggcgagcgtcagatactcgtcccagcccaacagcgagtccgccacctcccggcccaccccgccgaacatcccggccgaaatggcgtccagcgccgctctcaattccgggtcctgttcgtagaagcgtttcgcgtcgtatccgccgagtcgcacctcggcggcctggaaggcgtcgaggccgaacaggaagaagttctcctcgccgacccgggcgcggatctcgatgttggcgccgtccagggtgccgatggtgaccgcgccgttgagcgccagtttcatgttgccggtgccgctggcctccttgccggccagcgagatctgctcgctgaggtcggcggccggaatgatgcgttcggccagggtgacgttgtagttctcggcgaacacgattctcaggtacggcgcgaccaccggatccgccgcgatcgtcgcgccgaccgcgttgatcagccggatgatgctcttcgcggcgtggtaggccggggccgccttgccggcgaacagcacggtgcgcggcacccagtcgccggtcgggtgctgccggatccggtggtacatggtgatcacgtgcaggagtttgagctgctgccgcttgtactcgtggaaccttttgatcatcacgtcggtgagcgagtccgggtcgccggccgccaggtccaccttgttggcgcgcttcaccgcccgccagcgttcggcgaacgacgcgtccccggcgagacgttccagcccggcgagctgttccaggtcgtgcagccagccgtcgccgccgagcccctcggtgatcaggtcggagagccgcgggttggcgagtttgacgaaccggcggggcgagacgccgttggtgacgttctggaacttggccggccacaggtcggcgaagtcgttcagcacggtttcgcgcagcagtttcgagtgcagctcggcgaccccgttgaccgcctcggtgccgaccacggcgagatgcgccatccggacccggcgctcaccctcctcgccgatgatcgacattcggcggacccggtcggtgtcgcccgggaaccgctgctcgacctcgcgcaggaacagcatgttgatcagatagatgatctccaggtgccggggcaggagccgctcgaacaggtgcaccggccaggtctccagggcttccggcagcagcgtgtgacaggtgtaggcgaacgtccgccgggtgatcgaccaggcccggtcccagtccagcccgtactcgtcgaccagcagccgcatcagctccgggatggcgatcgtcggatgcgtgtcgttgagctggatgacgttcttctcggcgaagtcgtcccagtccgtgttgcgcatccggaaccgccggatgatgtcccgcagcgagcaggagcagaggaaatactgctgcttgaggcgcaactcgcggcccagctcggtgctgtcgtcggggtacaggaccttgctgatgttctccgcgcggaccgcttcctgcaccgcctcggcatactgcccggccgagaaccgcgacaggtcgaacgaggcctcactgcctcgcgcccgccacagccgcacgatgttcaccgtctgcgtcccgtagcccgggacgagcatgtggctcggctcgccgagaaccacctcgccgggcagccaccgcttccggaccggtgacccggccaccggctcggtgtgtccgtagaagcccaccgtctgccggtcgtcgggcgccgggaattcccacgggttgccctggaacgcccagtcgtccggccgttccgcctgcgccccgttctccagcgactgccggaagatcccgaagtcgtaccggatgccgtagccgaccgccggaatgtcgcgggtcgccatcgagtcgaccaggcacgcggccagccgccccaggccgccgttgcccaggcccggctccacatccaggtcctcgatctcctccagcgtccgcccgagcgccttgaccgcctgcgcggcgatcgcacccgtggcggaatagagcagattctgctccaactgcgccccgagcagatactccgcggagaggtagtagacccaccgcggattgctggcgtaatgcgccgccgccgtccgcgcccgtcgatccgcgagccgatcccgcacggtgagcgcgagcgcctcgtacgcgtcccgtgggctggccgactcgaccgtggtgcccctgcggtaatagaggctgctcagcagatcctgttggaactcgtccgcggtggtgcccagtcgtcgcaggccgatgccctggctgccttggcgaagatccatgcggcccattctgccgcgacgacgtttccggccgctgacgttccccgttccacagagagaagaaccaatacaagatcaacttcaaggtcgcaggacgcatcgacccgccccgccacccgcggtcggtcaccggacccgatcgccggtcaccatgccgcctgtggtcggccggaccgcgggctgtccggccggcggaaccgggtacgccgaacgggactgcatcaacctccgctaacggttcgctgagagtggtccgccggcttccagttcgagccggcctccggcgaccgccgcgcgccgtacgcgttcgcctcggccggcggccagctccaggcccgcgagctgggtaaaccgtccgccccggcgacctggggcacgccgccgcgcgccgccgtccagccgcgcgccgcggccccgtaccggaccacgttcgtgatggacacccggaactggaccgcctggaacaagttcatgggcctgtggaacgccgacacctgggcgtacgtgccggtcgacaacccggcgaacaccctggaagcgaccgccgacctgccgcccggcaactacttcgtcaccgcgatgtacggcatctacggcgtcgacagctacctgatcaccaagtcgttcacggtcggcgcccggggcgcgcgctactgggcggtgccgatgaccggcgagtcgtccggcacgttcctcgccacctacctgcgggcgcccggcaccttcacggcctacatgacgcccggggtcacctggtcccggctggtcgattacggcagccagaacctgaacctgaccgacgtgaacctcggctccggggagaccggcaccgccgagacggtcggcgccgggccgctcatgccgggcaccgggcggtacggctcgcagacccgccgtgaacgggacaagctctacctgtacgagccgatccagctcaccgacaccgccggcaacccgggctcggacccgtccacctcgcgcaccacgatgacgctcagcgcgggcgggacggttctcaagacggccgcgtcgctcagcctggccgcggacgtgccgcccgccgcacagctgtacacactggatcagaccaccacgcaccggtcacagcagtccctgctgaacaccaggatccagaacacctggacgttctcgtcggcgaccacgaccagcgcccgactgccgctgatcgacgtggcggtcggcgccaccggtctcgacgcccgcaaccgggcgtccggcgggcccgtccagttgaccctcacgccgtcgacccggtccagtgacgcggtcacccgggtcgaccggctggagtggtcggccgacgacggcgccacctggaccgcggcgtcggtcaccacgggcggcgcgtcgatcaccgtgccgcccggtgcggcgttcgtgtcgctgcggatcaccgcggccaacgaccgggccggcaccctggtccggacggtgacccgcgccttcgccggccccgccgaacccgccgacgagaagctcggcaccaccggcgaattcggcggcgagctggagatctccggcgtcacggtgaacggcgggcagcccctcaccgtcggcaccgcgggcaccttcgaggcgatgaccgcgacgtacgcggtcagcgacccggtcaacgcgaccatccggtccggcctggtgctctaccacggctcgtacacccagccggacggcatcatcccggccagcgtcaactgcgtccgattccagcaggtcatcggccggtgcaccgccgacttccggtcgtacgaccaccgctgggcgctcaacagcaacgccctggccggcgactggcacgtggcgatctgggcggagaacgcggccggcacccggatgatcgaccggcacgacgcggccaccgtgaccctcaggaaagccacccagctgaccaccgacgccaccccggaacccgtcgccaagcaccggacgatcaccgtcgcgggggcgctgagcagggcggactgggagacgtggacgttccggccgtacgccgggcagaccgtcgacctgcaattcctccagtcgggtgcgagcagctggaacgggctccggacggccacctcggatgccgcgggaaagctgaggacgacgacgccggcggtgacttccggggcgttccgctaccgctatgccggcgacggcgcgtcggccggaatcagcagcgccgccgactccgtcgccgtgcaatagcggaccgctcggcgctgccggtctgcaccgctcgcggcgccgcgacggtgcctacccctcggacaactcgttgaccgccgccgggacctccgggaacgtcgctacggcggcggtcacgaaccgggggtcgaagtccggcagccggcgtaccccgctctgcaggcaggcgatgaagcggatcccggcgccgccggcggccaccgcgtcacccggcgagtcaccgacgtagacgcattcctcggggtggaacccggtctcggcgagcagttcgtcgaaaacccggggatccggtttgcggtaccgggtgttgtcctggtggtacgcccgggtgacccgtccggccagcacgtggtccggcgccagcaggtgctgcacctccggaccggtgcgggaggtcagcagcatgaccgtgtgaccggtgccgaccaggcgatcgagggcgtccaggttgtccggcgggatcacgtcgagtcggccgtcggccagataccgctgatgcgccgcggggaacagcgccgcgaaccgctccaggtcgacgcccggcgaccggtgcggcatcgcgtcgagcagcgtctcgccccaggtggccaggtgcaccgcgcggctcatcggcggctggccgacctgcgccaggacgtcgttctccaggtcgaacgacgccgcctcggtcaggcacagcgtgtcgtccacgtcgatgatcaccgcacgaatcacggatgccagggtaggggtcgccgcccgtcccgatggtggcgcgtcgccgacctgtccgatcatccgggatccggcagtcgtcggagccgccgcccggcggtggtgtgcaagactcccggctgtgctggatcggttgttgccccaccccgtgcgatccgctttcgccctcaccgacgatccggacgaggcgtgttacccgggtgaggaatcgctggtcgcgaccgcggtcccgaaccgccgccgggaggtggtgaccgcccgccgctgcgcccgcgaggcgctgctcgccctcggtcacgcccccgccgcgatcccgcgcggcccccaccgggaaccgctctggccggccggcgtggtcggcagcatcacgcactgcaccggcttccgtggcgccgcggtcgcccacaccggcgagctgaccggcgtcggcatcgacgccgagccgcacgccgcactgccgccccgggtgctgggcgcggtgaccgacccggtcgagcgcgccatgctggaccggctcgccaccacgcacccggagacctgctgggaccggctgttgttcagcgccaaggagtcgatctacaaggcgtggtttccgctgaccggccgctggctcggtttcgaggacgcccgcctggacatcgacccggacggcaccttcgtcgggcacatcctgatcgagtcgccgctgccccggctggccggccggcacctggtcgaccggggcctgatcctgaccgcggtgtcagttcccgcacaggggtgagagcggcttgccgtcgttgcgactggcgatccgcgcgacccggcacaggtccgggaggaccgcgaccgggtcgagccgccacaccccgaatgtgtggtcgaagccggagctggccagcaggctcccgtccggcgcgaaggcgagcgcgccggaccggtagtcgtgaccgttcagggtcgccgtgagcgaccgggcgccgacgtcccagaggtgcacccgcccgtcgaactcggtggaggccagcgtccggccgtccggcgcgaaggcgatcgcgtcgacctgctgaatctgcggcggggtctgccaccgcaccggggcgccgtccggctcgcggacctcgaccgagccgttggttccggtgaccgcgaccgcaccgtcgaccggtgacaccgcgatgtcgagcggccgatagccgagcgggacgctgccggccgggctgaagtcggcggtgcgccagcgctgcagggcgtagccgtcgtggtatccgcccgccacggtcagtccggtgaacagcgaggtcccgtcccggctgaacgccaccgaggacggcgtggcgcccagcgggaaccgggcccggaccgcctgccggccgacgtcgtagacgagcgcctgatccgcctgcccggtgaccccccgcttggtgagatcctcctgggactgctgggtgaccaccgcgatcagggatctgtccggagacacggcgaggtcggccggcgtgccgggcagcgggacggtcacgcgcaccttgccggtcgccgcgtcgcgcacctcgagtctgccgttcgtggtgctgtcgaccagcgtgcccgggtccgggaaggcgaccgagatcgggacgccgtcggtcgggatctcggtgagcagggcccgggagcccgggtcccagacccgcaccttgccgtcctcgccggcggtcgccagccgccggccgtccggcgcgaaggcgctggtgatcacccgcgttccgtgcggcagccaggtggtcgcccgccggaacaccgcggtcggcgcgtcgacgccggtgaccgcgatcgtccggccgtccggggagaccgccggcgacgggagcgacgccaccccggtgtcctccgtccggcgatcaccgccggccagggcgaacagggcgaccgaatgcagaccgttgttgaccacgacgacgccgtcgggagtcacccggatcggagccgcgaagggggtcaccgactcggtgatcatcgtttgccggcgccggcccgacgggatcgcccactgggtgagctggccgagccggttcgcgccgatcagcgtgccgtccggggcgaacgcgacgtacgcggtgtccgggacggtggtgaccagccgcccgtcgctgatccgccacaccttggccggagacggtacgggccgggtgaccgccacgtatcgcccgtcggcgctgatcgcgaggtcgtaggcggcgtagtcaccgaccggcaacgaccggatcagccgtccggaggcggcgtcccacatccccagctcgaagggcatgccctccttggtgtcggtgcgccagcccatcgccgtcgaggtcccgggcagccaggccgccccggcgccgcccggcagggcccggaccaggtcaccggtggcggcgtcccagatgtacaggccgtttctcgcggcgacgccggcgagcaggaaccggccgtccggcgagaacgccaacgaccgcgtgtagctgcgggtgctccggttcggcgggaccatccgctgcccgaccggcgtgagcgtggtggcgtcccagagccggaccgacccgtcgccgtgcccgatcgcgatgcgcctgccgtccgggctgaacgccgcggcggtgccacccgggtcggtgccgagcgttccgatggcgttgaccatctgcgcggagagcaccgccccgcgtgcctcggtggtctcgcgcacctgccagctgtcgagtgcccgccggaccgcggcgatctcgtcccggttcagcgcgttcaccgcctcggccgcgtactgccgggacgccgcctcctgctggctcgcctgggcctcccgttgccgggtggccgccacgtgctgccggtccagcgccaccagcccgcccgcgacggccagcagcagcgccacaccgagcccggcggctagctagctagcaggtccgggtcgcggccggagcggtcccagtcctcggccgcctccgcgacgcgttgccgcagctccagatcggaccgggcctccgccacccagccggccagccggggccacccggtcagcagcgcctcgtggctgatctccacggtgtcggtcccggcggtgaccaggcgctcggcgaccagtcggtccagcacccgggagccgtccggggaccgccggccacgccgccgcaccacggtgccggtgccggtcatcgtcaccagggagagcagggccgcgcgcagggccgcctgctcctccgggcccagccccaggtagatccgttccgccgtctcggccaccgcgtgccggatcccgccggtcgcccggtaggcctcgacggtgagctgatccccgtcccgtcgctcccaggtcgcgcgcaacgcgtgtgccagcagcggcagcgcgcccggctcataaccgccggccccggcgccgccctcgccgaggtcgcgcagcatcagctcgggcaggcccgggtcgaccttcagcccggcctgctcggccggctcgaccacggcccgccgcagcgacccggcgtccagcgggccgagcacgacatgcccgccggccaggagtcgggccagcggcggcagctcgacgcaggccggatagaagtcggaccgcaccgcgatcatcaccagcgccggcgccgcggcggtcagcgcggccgcgaaggccagccgctcggccgggtcggcgcactgggtgaacagctcctcgaactggtcgaccacgatcaccggccgccggcccccggcggccgcccgcccggccagcgcgccgagcgacgcgggctcccggcgcacgtcgcgaagcaacccgtcgacgtcggccgccgggtcaccggcctgctccggggtggccccgggcaggccggcgaggtgccgcaccaggtcgcgcaggggagtggcgccgggggtgagcacgatccagggccaggccgtcgcggccgggccgagtcggccggcgccgatcgccgggagcaggccggcccgcaccagggaggacttgccgacgccggagaccccggtgacgaccaggggcggaccgcccaccagctgctcgctcaaccgggccagcagctcggccacctgcgtctcgcggccgcggaaccacggggcgtcggccggctggaaactggccagtccgggatagggcggcaccgagccggacagcggcggcgcggcgggggccgtctcctggttgacggcgagcagctgccggcggacctgttccagctgccggtgcagcagcagggtctgccccgcgaactgctgccgcagatcgtccagcgaccgccggacgtcggtgagcatccaccgcagcgagccgacgtcgctgcccagctcctcgaagaccgcctccagttgatgccggaagccgtcgtcggcggtggccgcctcggtcagcgcggtggcgaccgcgtcgatctcgtgcagcaccgcggagacctccgcctgcagccgcccgccccgctcgtcaccggcggtcagcagcggcagcagctcgtcggcgaccgcgtcacgccactgctgctcggtgatcgggccgccgccgcgcatccgctgggcggtgccggccagcacgtcggcgagatagttgctgcccaggcccccgagctgggccagcgccatggcgaacgcccccgggacgccgagcccggcgccggccaccggtgcgaccgccgaggcggtcaggaaggcgaggatcgcgtacggcccggcgctgcgcagtcgtgcgcgaccgcgccgtccgctctcccgcacccaggaccgcacgccggcgcgagcgcgctcgacggggccgggggtgtcgtccggatccggcacggcgaccctcctcggtggactgctggcatcgctggaggccccatgatggcatcgtcgggcgaccggcggcaccggccggatgacgggttccgcgccggcccggtccactgtgctgttgcccacgcgcgggccgcgcctgcaccactatgggtgagcgacatgcgacagtgcgcatcatgatcgatgcggacatcacccggcgggtggtcaccgaattcctggcgtacgtgcggtccggccgcgacccgggccgcgccaccgccctgatggcgccgcgggtgcgggcccaccaggtgcagtccgaggacccggtgacgatcgtccggacgcccgccgactacgccggtcacgtacaggagatgatcgacacctggggcgagttccacctgcaggtggaggacctgctggtggacggtgcccgagcctacgtccggctggcccagaccggccgccacaccgcgaccggccgggtggtccgccaggtcaacgcgatcgtctaccacgtcgagaacggccggatcaccgagtactggatgcagatcgaccgcgccggcctggccgcccagctcacctgaccgggtgcaccgcggggcgcagcggcgggcgcggcggtaccgcgccgggcgtacaccggaagtcgtcccggagcggacgcggtctttcgccgcgtcggcgacagtgggcggatgacggagcgcgcgtttcgattcggggtcatcgccgcgcaggcgcggaccggtgcggaatgggccgcgaatgcgcggcgggccgaggagctgggatacgacaccctgctcatcccggacaccctggtcacgctgtcgccgttcgcggcgctggccgcggcggccgcggccacccggacgctgcgggtgggcacgtatgtgctgaacgcccccaaccggaccgcggcccaggtggcctgggagacgcggagtctgcagacgatcagcgatgggcggttcgagctcggggtcggcggcgggcggccgggcgggcacgccgacaccgcggcgctgggcgggttgtgggggacgccgggggagcggctgcggcgcacggcggacacgatcgcggcggcacgcggcctgccgatgccgcccacggtgctggtggcggcctcgaaaccggggatgatgcggctcgcggcggaacaggcggacgtggtgaccttcggcctgccgccggtcgccacaccgggggagctggcgcgggcggcgacggagttccgtggcctgtcgaaccgggcggatcaggtggagctgctggtgggggtgaccgctttcgccccgaccatcttcgcgctgcccgcctggctgtcgcggcaggtgggcggggatccgcgggagatggcggcggccggggcggcgacgttcctgatcggggacgccgaccacgcggcggaggagctgctgcggcggcgagccgcgggaggtttctcgtacttcgcggtgaacgggccgttcatggaggccttcgcgccggtcatccagcgtctgcgcggcaccgggccggtcggcgggtcagcggagccggcggccccggacggcgaccgccgcggcggtgagcggcggccggcgggcacgcccggcccgtcgacgaaggtcgccgcggccagccggctccaccgcccgacggaggcctcgtaggggttcacccgagcgccaggcatcggtcatgctgcgagcccggggcgatcagatctggcggtcacgtccggcgaaggcgccggccacgatctgcggcaccatcaggcccaccatgatgcccagcggcgccttccacccgtgcgtcgcgtcatgcagcgccccgatcaggatcggccccgggatcgcgatcagatatcccacaccctgcgcgaacgcggacagccgcaccaccgtgcccggcgtccgcccgcgcagcgcgatcatggtgagcacgagcgggaaggccgtgttcaccacgcccagcaggaccgcccacagccacggcgccgccgcggggtccgcccacagcccggcgtacccggcgatcccgaacgcccccaggcagatcgcgatcaggctttgcgaccggacccgcccggccaccgccgacagcgccatccccagcggcaccccgagcagggaggtggtggcaaagagcacgccggccttctccgcggacagccccgagtcgcggtagatctgcggcaaccagccgatgatcacgtacgccgaggtggactgcatgccgaagtagacggccagcgcccaggcgatcggctgccggatcatccgcaccggcgcggtggcggccgccggcgcggcccggcgcggcccggtccggcgggccatcagcagccatggaggcagcgccaccacggccgcgagcgcccagcaggccagcccgagacgccagtcgccgaagctctcggtcagcggcacggtgatcgcggccgccgtggtcgcccccaggttcagcgcgaccgagtagagcccggtcaccgcgccgacctgggtcgggaagaaatccttgacgatcgacggcagcagcacgttggcgagcgcgatgccggccagcgcgaccgcgctgagcagcaggaacaccgccgagttgggcgcgaagggccgggtcgccaggccgatggtgagcagcaccaggccgccggcgatgaccggcaccgggccgatccgccgggcgatccggggcgcgagcaggccgacggtggcgaaacagaggaccgggaccgaggtgagcaggccggcgaccgtgccgctcatgtgcaggccggcgcggatctcggtgaggaccggcccgatgctggtcaccgcgagccgcaggttggccgcgccgaggatgagcgcgatgagggcgagggtccgcccccgacgcgggccggtcagtcgatcttcaagttgttcgtcccgcagtgccacaagaccatcatcgccgggccggggcggccccggtcagcgggtctcctgttcgcgttcgacctgcgcgttccactccctcttgctggactgccagccgtcctcgttcaacccgcggcgccagtagccggagatcgacagctgctccatcggcagctcccgctcgacccgcagatagccgcgcagctccttgacgaagccggcctcgccgtgcacgaaggcgtgcacccgcccggccgggaactccagctcgcgcaccgctttcaccagcgcctcgccgaccggccggtcaccccggtgcagccagacgatctcggcgtccgcggcggtgggcaactcctgctcctcgtcgggaccgtcgacctccagatacgcccggacgggcgcgccgtcgggcatgccggcgagcgcggcggcgatcgccggcagggcgctctcgtcgccggcgagcaggtgccagtccgcgtcgggcgacggcgcatacgccccgccggggccggagaaccggaccacgtcgccgggccgggcccgcgccgcccacggcccggcgatcccctcgtcgccgtgcaccacgaagtcgacccacagctcgggcacctcgggcagccacttacgcaccgtgtacgtgcggacgagcggccagtcctcgcgcggcatggtctcgcggatcgtgccgacgtcgaacggctccggataggtgacgccgtcgcgcgggaacagcaccttgatgtagtggtcggtgaagcgcgcggcgtcgagccggccgatcgcctcgccgccgatcaccacccgcaccatgtgcggcgtcagccgctccacccgggtgaccacgccctgatgggccggccgcgctggtctgttcgccatctctgcacctcaactcgccggaggggatctccggcaggtaaggctacccttcatttcggccggacgaccgcccccatcgggcactcttcgatttccggcgggcacccctgccgggtcacggtcgccggcgacggcggccgccgatccggtggtacgacgtgggcagggcggcgcccggcgaagagtacgccggagcaccgccctgtgaatgtccaccgtggccggtggccggttcagtaccgccgcggccgggaccgggcgaaggcgaacccgatgatcgcgagaaggatcaccacggccccgcccccgaacaccgccgggtggtcgctgagcagcgtcagcggcccgctcttggtgctcgccggcggctcggcgaccgtctcgcccgggcccccggtgcccttcggcgccgggttgtcggccgcgccgacgttcacgccgtagtcggcggccggtgcggcgtccccggtcggggtcgcctccggctcggcctttctggtggtcttcgccggggcggccgccgggtcgccgccggaggagccggcggtcgaggagtcgctgccggcggtcgaggaggcggtggccgccttggtcggcgccttggtggtcggcttcgtcgtgatgatcgtcgacttggtctgcccgaccgtctcgccgccgttgtccgtcttggtcggggccggggtgggcaccacggtcgacttcaccgtcgccttgggcgtggccgtcgcgttcccgccggtgttgttgttcccgccgcccccggtgttgttgttcccggtgttggcgccgccgcccgtgttgttcccgccctggttgccgccggtctggttgccgccgccctggttgccaccggtctggttgccgccgccctggttgccaccggtctggttgccgccgccctggttgccaccggtctggttctagctagctagcccgccgccctggttgccaccgtttccggcgcggacgaggatccgcacggcgtcgatggccggcgtctgattggcccgctccatcatcggcgtgcggtgcgacccgtcaccggcccacgacgcgcactgcgcggtgccctcggccggcagccccggcacctggatggtcaccgtgtccggcgtccgcccgcccttgccgtcctcggtcgccacgaagaacgccggcaccggatccgggtcgggcgcggaccgggtgctggccagcatccggcacgcggtgtggaagtggccgcggacgatcccgttctgcagcacgctggactcgacgtagtagccgcccttgccggccgcgaggaaccggtcgcggatcaggttgcgggtgctcaccttgagcgtgaacggcgtgttcggcgcgaccaccaccggcgccgcggtgatcagcaacgacgcgtcgttggcggccgaggccacctcaccgaactcggtggagacgcagcggtcacccttctggaagccgtcgtgcgccgggagccggctgtcgatgcaggtgtcggtgaggatcttctgcccgttgacgatcttgcccgcgccgctctggctcgcggccttggcctgcggggtctcgtcggcgtgcgacaactgggtgaacccgatcgcgccgccggcggccagcacgaccgcaccggcggccagcagccggccacgtcccgacccggcggccgtgaggccggtacgacggtgacccgtgcttcccatgacgtgcccttcgatggtgacgttcgccattgtgtgacgccgacgcccagacgttaggagcagcccggtgagaaatcaattccggaacaatatttaatgataccgcgatcgaaacttaaggaaaaatatgtggtgacccgcgaacccccggcatcagccgaacggatgatgccgggggttcatcgtgatcggcagatttttcgctgacctgccctaactcaaccacaccccgcagcccgcgtaaacgctgccatgactgtctgtgagcaagctgtgggttggtcgcggccttttccgcgcccggcacccggccggcgggaatgggctgaccaagcctttcgagaatggtgaaaaagatgcccgctttcgccgtggtcgtggccgggtccggcggcatgggcagtgccgccgtccacccctggccgccgggtgctcggggtggggtggaggtcgaaccgtggcgtgtggcttctctcgggcgcggcttcaggttcgtgccggtgatggggagtttcgcgccgacccggcgccgaccgggacgacccgcttcgacctcggccggttcgcgccgtccccgtccggggcgggtctacacgagtgagccggggattcggcccgaagggaagaaataaccacaactaggtcacgcgactccgaagtctgccctaccttaggccaggtcttagtcgggcaaatcgactgaaatggagcatgtcgtgcgtctttcccgttcatcgcggcagacgcggggtggcctgctggtctccgccgtgctgtcgatactcgccgccgtgcccgccacgggcgcgccggccgcaccgagcgccatgcacgagagccacccgatcaccgacggccacgggcacgacctggagctgaacggcaccgccgcgctgatcacccggaccggcaccggcaagcggatcatccagctcaccgccggcggctacaagcagatcggctccgcctggtcgaccgggaaggtcgacctggaccggtcgttcagcacgtcgttcaaggccttcctgcaccacaaccggccgggcggggacggcatcgcgttcctcgcccagggccacgggccgcgcgcgctcggcggctggggcggcggcctcggctaccgcggcatccgccgcagcgtggcggtcgagttcgacaccttccagaactccaccgatccgaacagcaaccacctggccgtggtgctcggcggtaatccggaccggcacctcaaggcggtgaccgcgtcgattccgctgtacggcaagccgttccaggcgcggatcacctacggcggcgccgaccaccggctgcgcgtgtacgtgcggggcctgtaccgcaccgccaaggagaaattgatgctggacgagcgggtcgacgtggcgcgcgagaccggtgtccgtgcgggctggctcggcttcaccggcgcgaccggcgaccgggtctcccaccaggacgtctacgactggacggtcgacgcgccgcaggcgtgacggcatgccggcgtcgtgtgagcggcgccggccgcccctcccggcggaccggtgacacccgtccgccacctccccgcacccatgcgtccggcccgccgaggccgcctccaccctgcccgatcggagacaatccatgcccacggtcgaccgtgtgctcccgcccgagaccggcaccgaagagctcgaggagctcgaacagctcgaggaactcgaccagatcgaacagtccgtgaccggtaccgaaccgccggcccggccggcggccgaagccgaacccgagccgctggtcagcgtcgtcgtgccggcgctcaacgaggcccgcaacctgccgcacgtcttcgcccggctgccccgggtcgacgaggtgatcctggtcgacggcggctccaccgacgacacggtggcggtggcccgccggctgcggccggacatccgcgtcgtcacccagaaccgcaagggcaagggcaacgccctggcctgcggcttcgccgcctgcaccggcgacatcatcgtgatgatcgacgcggacgggtcgaccgacccgggcgagattccccgcttcctcgaagcgctgcgggccggcgccgacttcgccaagggctcccggttccgcgccggcggcggcagtgccgacatcacccggttgcgccgggccggcaacaggatgctcagcgtcctggtcaacatgctcttcggcacccgctacagcgacctctgctacggctacaacgcgttctgggcctgtcaccgggacgtcttcgacctggacagcacgtcgccggcgccggccggcgcggacgggcggctctggggcgacggcttcgagatcgagacgctgctcaccctgcgggccgcccgcgcccggctggcgatcgaggaggtctccagcttcgagcacgaccggatccacggggtgagcaacctgaacgcgttcaccgacggcatccgggtactgcgcaccatcgcccgggagtggccgcgcggcctgcgccgcgggtcccggcagccggccgggcgggcggcacgatgaggatcggcgtcgtctcgaacgcgtaccaccccgacatcggcggggtggagacgcacgtgcggcgcctgtgcgccgggctgatcgcggccggcgacgacgtcgaggtgctcacccagcacgccggccgcaccaccgaggtggtcgacggcgtgctggtccggcgtttcccgctgaccgtgccggcccgggactaccggatctcgctgccgctgtggcggtgggtgcgcgatcacgcggtggagtacgacgtgctgcacacgcacagctatcacgcgctggtctcgctgggcgccacgctcggacggcatccgaccccgctggtcttcacaccgcactatcacggcaccggacatacccggatacgtgccgcattacacccgatctatcggccgttcgggcgccgcatcgtcggccgggccggccggatcatctgcgtcacggaggccgaacgggacctgctgcaccgcgacttcccggaggcgcgtggccgggccgtggtgatcccgaacgggaccgacccgcgcccggtggtgcccgggaagcggaccggggtgcgtggcatcgtctgcgccggccggctggagcactacaagcgggtggaccgggtgatccgggcgatcgccgagctcgggccggcgtaccggctggacgtggtcggtgacggaccggcgctcggcgcgctgcggcaggtcaccggccgcctcggagtggccggccgggtggtcttccacggccggctcgacgacgccgcgttcgccggctgcctggcccgggcgtccgcggcggtctccgcctcggcgcacgaggcgttcgggatgaccgtcgccgacgcgctggccgccggcatccccacggtcgcctcgccgatcccggcccaccgcgagctgaccgggatggccggtagcaacgcgtgggtccggctgaccgatccggaggacaccacggcactggccgacgcgctgcgcgacgccgtcgcggccggccggtcggccaccgcggcgccgctgcccacctgggacgacgtggtcgccgcgacccgggaggtgtactccgcgatcaccgggatgccgttgcccaccggcgcgggagcgggaggccggtgagcgcggtcaccgcccggcccgcgccggggctcgtcgggtcgcggtccggccgcccgcggtcgccggtcaccgaggcgctctggtgcgcggcctcgctgagcgtggcgggggcggccggcaccgcggcgatcgtgaccgcgtaccaccgggccgaatgggggcgtggcgggcagttcggctggttctgggccgggatgctgctgttcaccctgccggtcggctggtgggccctgcgccgcggcacctcgccgcggctgcggctggccgtgctgatcggctacggggccttcacctacctgccgaaactactgcggcacccgagcggcccgctctaccacgacgagtacgcgcactggggccagagccaccacatcctggccgacggccggctcttcgaggccaacccgatcgtccgggtgatcggcgactacccgggtctgcacgcctgcgtcgccggactggccgcgctcaccgggctgagcgtctggcaggccgccctgttcgtgctgaccaccgcgcacgtgctgctcaccctgggggtggcggtgctcgccgggcaactgcggccggacgcgcggatcgccgcagcggccgccgtcggctacagcctgaacagttcgttcctctacttcgacacccagctcggctacgagtcgctggccatcggcatcctggtctgggcgctggtcgcggcggtccgggcgagccgggccaccaccaccggggcccggctcggctgggccgcctgcaccctgctgctggccctggtgatgaccgccacgcaccacctgaccgcgctctggatgaccgggattctcgggctgttcgcgctggtcaccacggtccagtcggtgcgggtccgggagctgatcacgccggcccgggtggtctgggcgctgacctcgggcaccgcgctgatcgtggcgatctggctgggcatcatcgccccgcgcaccggcagctacctcgacccgtacctgggccgggcgctgacccagatcggcggcctggccggcggcgaggagggcggccgggagctgttcagcaagtcggtgctgccctggtgggagcagaccgcggcgtacatcgccccgggcctggcgaccgtcgccatgctcggcgcgctgctgctgtggtggcgtcgccggcacaccgaggagccggtcacccacgccgggatcaccgcgatgctgctgctcggcggcctgtacttcccggccaccctgctgatcctcaccccggccggggccgagggcgcgcgccggtcctgggcgttcagctatctcggcctggccatcgcggcggcgccggcggcggtggcgctgctcgacctgttcgccggccgggtgctgcgctcgatcgccggtgccctgctcggcacgatcggcgcggtgctgctggtcggcaacaacgcggccgggatgaatccgtcgtaccggttccccgggccgccggtctacggctcggacacccgggccgccaccccggaggtgctggccgcggcacactggctgctggacacccaggggcgcgggatccggctggtcgccgaccgctactccgggctgatcctgggctcgtacggtgagcagcagccggccaccgggtcggcgagcttcccggcgtacgacctgtaccgcgcccgccccgggcagccgatcgaccggcacctgctggcccagctgcgcgactggcatttcgagttcctggtggtcgaccggcggatggccgagcaggtgccggacatcaacatctacttcgagacgaacgagccactgcgccacgacggggtgcctgccttcgaccgggcgcagctcaccaagttcgacacgatgccctggttgatcaaggtctacgacggcccgcacctggcgatctaccgcttcgacttcgacagcctggctcacccgacggcgggacgcccccaatgaagatgatcttccggccgctggtcacggcgtacgcaagtctctcgatcttgctgccggccgccggcctgccctggccggtgctgctgccggcctgcctgctcgccctgctcgccatcggcgagctctgggtcttcgccctggccgggcggccggccgaggccggcatcccggcggtccgggccggcctggcggtgctcaccggcctgctcacgctgcccgcggtggcgctgctgctgcacccgctgcgggccccggtgagcccggtgccgctgatcgccggggccgccctgctggccaccgtgctcggcgtggccgggctgctgcgcctgtactacagccgccgatgggacgacgaggacgacgaggtgggcgtgcccgtgcagcgggtggccggcgaggccggcgaccgcccgggcgcgcggatccccggcacgttgcgcaccgccgcggccatcgtgctgccgatcgcgctgtcgctgctcgtcggcggggtggcgatccgcgcggtggagcggggctcgcacccggccctgcccggctacctgacggtggcgctgggcggctgggcggccgggctcacccacccggtcgcggtgccggcccgcggcctggccgtgccggtccggatcaccagttccgggctgccgaccagcaccgcctggctgcgcctgcgggtgggcgccgcggtcgtggcgacccgccaggtgaccgtgggcagcggcaaggtctacgcgctcagcgtgcgggtgccggcgttgccgccggacggctgcctgcgaccggtcgggatcagcgtgggcgggaccggcacggtcttctacgcccgctccgcgaccaccgtgccggcccggcggcggaccgcgtgctgatcaccgcgacccgccgggtgctggacgactcgctggcccgcaacagcctgctgatcatggcgacctcggtggtcaacggcgggctcggttacctctactggctgctggcggcgcgctcgctggctccggcgcaggtcggcacggccaccgcgctgatctcggcggccaccgcggtcagcatgatcgccaacctgggcgccgggcacatgttcatccaacggctgccgggcagcgccgcgccgctgtggggccggatcgtcggcggcggcctgctggccggcggtgccgccaccgcggccgcggccgccggggccgccgtgctggtgccgatggtcgcggtgaacttcggattcctggcccggccggccggcgcggtcgcgatgatcggcacggcgaccgcgatcaccgccaccacgctgctcgacaacgtgtatgtggcgcaccgggccggccacgggatgttcgtccgcaatctgggccttgccgccggcaaaatcgtcgccctgttgggtctgctggcgctgggcgtgcacgcggccggtgtcgtggtgctctcctggaccctgccgaccatcgtggtcagcgcggcgaccgtgctcgccgggctgccccggctgcggcccggtgcccggctgcggctgaccgggctggccgccgaggtgccgcacctgcgggccgcgctgaccggccaccacctgatcaacctgacccaggcgggcccggccgcgctgctgccggtgctggtcaccgcgcggctcgggccgggcgccaacgcgcacttctacctcgcctggatgaccgcgtcgatgctgttcatggtctccccggcggtcgcctcggcgctgtacgccgaacgcaccaacgccgcccgggtcggcctgcgccgggccgcgctggtggtgctggccatggtcggcgcgccggccgcgctgctgctcgcggccggcggccggatcctggcgatgttcagcgccggatacgccgccgaggggtcgatgctgttgcagatcctggtgctggcggcgctgccggacgcggtgaacaacctggccgtggcgcactggcggtcgctcggcgagttccggctctgccgccggctcaacgcggtccgcgcggtcgcctgcctgtcgctgtcctggctgctgctgcccggcgccggggtgaccggggccgggatcgcctggctgaccggccagaccatgtcggcgctgctggtcggcgcggtcgcggtcgcactctccgcccgccggaaggccctcgcctgatgaagatcctgcacctgtccaacctgtaccacccggtgatcggcggcctggagcgcagcatcgcgaccagcagcgccgagctggtccgccgcggtcacgaggtcaccgtgctgacccttgcgacaccggccacccgtcaagatcaagagatgattgacggggtacgggtccgccgcgtccgcagcgtcgccaccaccctgctgcccgggatgaacgcggacgccgccaagccgttccaccccaccgtggccgacccgttcaccaccaccgcgatcgcccgggtgctgcgcgccgaacacttcgacgtggtgcacagccacgactggatgatgtacagctacctgccgctgcgccggacccggatcggccgcccgcacgtgcacaccgcgcacgacttcgggctgacctgcgtgcgcaagaccttcgcccgggccggccggcagtgctccgggccgggtccgatccgctgcgtgaactgtgccggcgcgcagtacggcggaccgcgctcgctggccctgaccgccgggctgcacgcgcaccggcaccgcggcatcgacgtgctcaccgcgatctccacctcggtcgccgccgcgctcggccaggcacggctgcccggtgacctgccggtgcgggtggtctccagcctggtcccggacgggctggacgcgctcgccgaccgcacgccccggccggactggctgccggccggggactacctgctcttcgtcggggcgctcgggccgcacaagggcatcggggtgctgttcgacgcgtaccgccgactgtgttcttcctggtccggcccattgccggcgctcgtctgcctgggcacgccgcggcccgacacgccaccggctccgcccggcacgctgatccggcacgacgtgccgcatgcgcaggtgatggcggccttccggggtgcggcggccggcgtggtgccgtcgttgaacgaggggatgggccaggtcgcggtggaggcgatgctcggcggcgcgccgctggtcgcctcggccgccggcgggctcaccgacgtcgtcgaggacggggtgagcgggctgctggtgccgcccggcgacccggacgcgctgcacgccgcactgcgccgggtgctcaccgaacccggcctcgccgaccggctgcgggcggccggtcggcagcgcgggctggacttcaccgcggcccgcgtcgtcccgcagatcgaggaggtctaccgtgcctgtgtcgcgtcgtcctagggtcgtggtcgccggttccgggtggcacttcctgtccgggatcagctattacacctgtcgattgagcaacgctatggacgagcggtacgacgtgggcgcgatcctgatgcgccggctgctcccggcccggctctaccccgggcgcgaccgggtcgggcagcggctcagcgacctggcgtacgcgccgggcgtcgaggtcttcgacggcgtcgactggtgggccgcgccgagcctgccccgggccgtcgccttcctgcgcgagcagcggcccgacgtgctggtgctgcagtggtggaccggcgcggtgctgcactcctatctggcgctggcggccgccgcccggcggatggggatccgggtggtgatcgagttccacgaggtgcaggacaccgcggagctgcgccactcctgggcggcccgctacgtccgggcggcgatccgcccgctgctggcccggacgtccggggtgatcgtgcactccgcctacgaccaagatcaactgaaccgggtgtacgacctgggcggcctgccgtccgagatcgccctgcacgggccgttcgatcatcacggcggcacgggacagcgggtgccgggacccgacgggatcgtgcgcctgctctatttcgggacgatccggccgtacaagggcctggaagatcttgtcgccgccttcggcgacctcggagcgaaccatcggctcaccgtggtgggggagacctgggagggctggacgctgccgctggaggcgatcgcggcgtccccggcccgggaccggatcaccgtggtcaaccgctacgtgccggacgccgaggtcgacgaatacttcgcggccgccgacgcggtcgtcctgccgtaccggcgcagctcggccagcggcccgctgcacatcgcgatgagccacgggctgccggtcgtcgtcacctcggtcggcggcctcgtggaagcggccggaccctatccgggcaccgtgttcgtaccgcccggcgacccggccgcgctcgccaccggcatccgggaagccgccggcctgatcgggcggcggcacaccgacccgtcatcgtgggaccggaccgtggacgcctatgaacgcctcttcacccggatcggcatcggccgggacgtcgtcacctcctcgccgtcctgacggttccccgatcgacaagccgattccgcgaccggcggcgtcggatcaggacatcgtcacgtcgtcgaaccaggcggtgccccggttgttccccgacttcaggtggagctgcacgccggccgcccccgccggggcggtcgcgtccacggtcagcttcgtccagccggtcgtgccggtcggcaacgccctcgacgacgtctgacccagccaccggtcgttggcgtcgaaccagctcagcgcgatctgggtggtaccggtcaggttctgtcccttggcccacgcctcggcgtgccaccgcaggcccggctggaccggggtgaccggggcggtccggatcgccggcaggccgtcatcggtgtgggaggtgccggtgaacttcaccgaaccggaccccgaatgcgcgaccccgttcacccgcaccgcggggccggcatcggacaggtacggccgccacggcgaattgccggccggcgcctcgaaacccaggtccagcacgctgttcgtcagaggttgaccggcccagtacgccttcaccacggccgccgccgccttcgccgagccgtccgcccggtacaggccgtacttgtactgcgccgggatcttcgacacggccgaattcgtcgggatggcaccgtcggagaagtcggtgagcgtccacggcgccaccgaacccaccccggcgacccgggccgccgcgaacacccgcgccaggtaggcggcctgctcaccctcggtgccggacaccgtgctcagcccggtctcgccgatcacgatcggcagcggggccgccgcggcctgcgccgtgcggatctcggccagcgaccgctccgagttgccgtagaagtggaagtccaggtagtcgagcggggtcgcggccagcgtcgcccggatctgcgacagaccgttcgacccggtggcgccggacaccgacagggtcagcggcatcgtcggcaccgccgcccggatgctcggaatgatcttcttgacccaggtgacggcgcgcgcgtcggacgggtcgaactcgttctgcacctcgaccgacaggacccgcgggtcgttcgcgtacggggcgaggacggccctggcccacgcggcgctgccggccgtgtcggtgtagccctcccaccagtcgaacagggtcagcttgacggtgagcccgtgcccgtcggcgatgctgatcagcttgttgagcctggcggtgtagtccgccttcggcgtcggatagccgaacgtgctcgggaagacgatgacccgcacgtcgtcggcgcccagtgcggccgccttggtcagatccgcctcgatccgcgccgcgtcgaaccgggtccacatcgccgaccacccggcgttcgacgggtagtagttgatcgtcttcgcggtgcgcaccgcgtccagccggctcgccagcgtcggcgtccccttgaccgtcgccttcgccggtgccgcggtggcaccggcgggtgcgcccgcacccgcgttgccgcccgggcccggcttcgccggggtcggcgcgggcttggcggcgggcgtcttcaccggcgccgccccgggcttggcggcaggcgtcttcaccggtgccgccccggtcttgacggtcgccttcgccggcgccggcttggtggccgcggaggccaccccgtgctgtgcgaagacggaaaggagaagtgaagaggccagaatcgcggcacgtcgaccgacaagtttcatgggggagcccttcacggagttgccttcggtggcccctcctttcggcgctccagcacggtgccgtcaggtaactcgtcgatgcagtgcggttgccctccgttgccgatcaggtgcaccccgtcgattcccccgcgtcctgctgatcgaccacccccgcccggtgctgcgtctttcccgctgttcgctcgctatgggatcgccgtgccaccctcggtcgggtagtgccgcggggtgtagacgaccggatcgccgttcccggtggccaccgcccgggtctgggaggagcccacgatcagcaggcagcgcatgtcgatgctcgccgggtccagagcgccgagcgtggtgacccgcaccgactcggccggcccgccgacgtcccggcccaccaccaccggggtgctcggcgcacggtgttccagcagcagttcccgtgcccggaccagctgctccttgcgcgactgcgaagccgggttgtagatcgcgatgaccaggtcggccgccgccgccccggccagccgggactcgatcaccgaccagggcttgagccgatcggacagcgacatgacgcagaagtcgtgaccgagcggcgcccccgcccggctcgccaccgcctgcgccgcggtgagccccggcacgacccgcaccgtgacgtccttccactgcgggtcctcggccacctccagcaccgcggcggccatcgcgaacaccccgggatccccggacgacaccaccgccacccgccgtccccgcttggccagatccagcgcgaacgcggcccgctcggcctccacccggttgtccgaggcgtgccgccgctgccgcgcgtcgaccggcacccgatcgatgtaggtcgtgtatcccaccagatcgtccgcctccgccagcgccgcccgggcctccggggtcagccactcggccgcccccgggccgagcccgaccacggtcacccgccccgccccggcacccccgccgccaccggaaccaacggctgccgccgcgtccatgccgcgggcgcccacgccatgagcgtccgcaccgcgggcgtccgcgcccacgcccacgcccacgcccacgcccacgcccacgcccacgccatgagcgtccgcaccgcgggcgtccgcgcccacgccggaggcatccggcttcgcgtcgagcccggatgcctccgcccggtccgcgggagcgctcgccgtgccgccggcggcgagcgagccgttggcttcggcgaaggcggtggcggcggggctgggcaggagggcgagcgagaagtagggcaccgtgtccggatcgatgtcggacaggcggccgacccgttccgcggccatggtggcccgttcgacgtagaaggcatcgtccagccggccggcctcggccagcgccgagcgcaccccgtcgaaggtccgtccgagcttcatcacggcggccgagtcggtggccgccaggcgccgggcgagttcggccgggggcagtgtgccgggcagcacggtgagcacctcgtcgcgttccatcaggggccggccgagcaccgcggacgccgcgctcaccgaggtcaccccggggaccacgaccgtctcgtaccggtgcgcgagccgcttgtgcatgtgcatgtacgacccgtagaagaacggatcgccctcggccaggaccaccacgtcgcgcccggcgtccagatgagccgccagccgccccgccgcctgctcgtagaactcgtcgatcgccccctgatatccccccggatgatcagtggtcccggtggtcaccgggtagatcagcgcctcctcgatctgcccgtcccgcagatacccggcggcgatcgcccgagcgttgctgcgcccgtgccgggccgcgtgataggcgatcacgtcggccttctcgatcagccgggccgccttgacggtgaccagttcggggtcgccgggccccagcccgaccccgtaaagccgcccacgaaccacaccgtccgtcacagtccccaccttgccgcttcccgtcccggccccgccctccggcgccgtccaccacaccgatcccgcctccggacctcggccgtcggcgagccacaccaatcccgccgccggatcccggccgtcggcgaacaaccccgcctccggaccccggccgccgccgaagcgcgccgagtccggcgccgggcggcacccgctactccgcctccgaggcgagagcgttgacggcggcggcggtcatcgcgctgccgccgcgccggccgcgaacgatcagatactccagcccggactcggcgagcgcgtccttggactcggccgcgccgatgaaaccgaccgggatgcccagcacggccgccggccgcggcgcgcccgcctcgatcatctccaacaggcggaacagggcggtcggcgcgttgccgatcgcgaccaccgcgccgtcgaggcggtcgccccagaggtcgagggcggcggcgctgcgcgtgttgccgatccgcgcggcgatcccgggcacggcgggatcgcggagcgtgcagatcacgtcattggcagcgggcaggcgccgccgggtcaccccggacgccaccatctcggcgtcgcagaggatcggcgccccgccgagcagcgccttgcgggccgcggccgccacccccgggctgtaccgcacgtccggcaccaggtcgaccatcccgcaggcgtggatcatccgaaccaccacgcgcgccacatcctcgggcagcccgctcaggtccgcctcggcccggatggtcgcgaacgaccgccggtagatctccgcgccgtcgcgttcgtagtccatcagcctctcctcgccgccgccaccacgtcacccagcgctcccgccggcatgacctcgaccaccgtctccggatccgcccgtcgcgtcaccgtgtatcccgccccaccggcgccgagcgaaccgggcgcagccgggctcgccgcggtcgcctccacccggacgtgcgggccggccgggctgccgcaggcacgctcgcagccggcccagtggaccggcaggccgtcggcgaagccggtcgcgacctcggcgtcggcgcggatgtcggcccgggacttcgcgcagccggggcggccggcgcacgcggtgaccccggtccagcgggaggtcggggtcaccaccaggccggtcgccgccatccgcccggcccaggccgcggcgtcctccggagtgaggccggggaccagcacaccgcgccacggcgtgacaaccaggcgctcggcctccgccaggagcctcgactgccggctttcgagccgacccaacggcaccagcgcacccgcggcgaactgcccgtttccggtcaccacaccgaccagcgcgccagcggcgtcctgctcgtttccggtcaccacgccgaccagcgcgccagcggcgtcctgctcgtgtccggtcgtcacgccggccagcgggtcggtcgcagccggaccgcctccaccgggggccggcccggcgggaacctcggccgtggcgagaccgagcgccgcggcgacacgcgcggagacccgggccgcgccgtcggtcagctcgcgcaaccgccacgcggccgcgccgccgccgcgctgcgcctcccgctcggccaggaacgcgtgcgcgctcgccagcagagcctcgatcaccgagtcgtgggtcacgcgcagcccggtgtcgcgccccccgaacgtcagggcgaaccggtcgccggccggggagccggcgagcgggacggcggtgacgtcggccgcgagcgggaccggcccgagagcgaacaggaacttgccgggcagcgcggccagcccgggatcggcgcagatcgccgcgtcgaggcgccggaccaggtcccgcacggtgtcgctcgccatcggcggggcggcgatgttgcgtaccgcgtcgtgggttgccgatggcagcagcccggcggcgcgcaggcgggccgccaccgtctccacccggtcttgcgggagtgctctgagctgcaggttcgctcgggaggtgagctccaggcgccggtcgccgaactcctcggccagctcgcgcaggcagcccagctgggcgccggtgagcatgccgccgggcagccggacccgcgccagcagcccgtcggcggcggcgtgcaaccgcagcgcgccggggcaggcgtcggtgtcggactgtcgaaggcgactcacggcccggatactacgggcggcccccgacaggaccggagcctcgggtcggcagccccctgaatcgtcagcggcgtcacaacgttcggtagcgtgtgcgacgacaagtgaattcgagcggcactgccgcggaggaagccggtgcgagtccggcgcggtcccgccactgtcaccgggtgagctgcccgggagccaggaactccggtcgccgtgattcttactacccggggcgcggaccccgaggggagcgcacgcgtgtttctgctgctgtcgacgtccgacacggacctgctcagcgcccgggccagcggctcggcatggcggctgggcaatccggcccgcaccggggtggccgatctgccggccctgctggacggggtggagctggtcgtggtccgcatcctgggcggccgccgggcctgggaggagggcctcgacgagctgctcggcggggatctgccggtggtggtgctgggcggcgagatggcgccggacgccgatctgatgaagctgtcgtcggtcccggccggcatcgccgcggacgcgcacacctatctggcgcagggcggcgccgacaatctgcggtcgctgcacgacttcctgtccgacacggtgctgctgaccggcaacggcttcgccccggcggtggagagcccgcagtgggggatcctgccgcgagcagcagagggatcagggtcggacggcccgacgatcgcggtcctctactaccgcgcgcaccacatggccggcaacaccgcgttcgtcgatgcgctctgccgggcgatcgaggcgaagggcgcccgcccgctgccgatcttcacggcctcgctgcgcaccgcccccgacgacctgctggccgagctgcgcaaggcggacgccctggtggtgacggtgctggcggccggtggcacccgaccggcgacggcgagcgccggcggtgacgacgaggcctgggacgtcggcgtgctggccgagctggacgtgccgatcctgcagggcctctgcctgaccagttcccgcgccacctgggaggccagcgacgacggcctgagcccgctggacgcggcgacgcaggtggcgattccggagttcgacggccggatcatcacggtcccgttctcgttcaaggagatcgatcaggacgggctctcggtgtacgtcgcggaccccgagcgggcgtctcgggtggccggcatcgcggtgtcgcacgcccgcctgcggcacatcccgccggccgagcgcaaggtcgcgctgatgctgtcggcctatccgacgaagcactcgcggatcggcaacgcggtcggcctggacacgcccgcctcgaccgtggcgctgctggcggcgctgaaggacaacggctacaagatcggcgatttctcggcgtacgacggtgacgggctgatccacacgctcatcgcggcgggtggccaggatccggactggctcaccgaggagcagctggccggcaacccggtgcggatctccggcgcccgctatcaggcctggttcgacaccctgcccgaggatttccgggcgagcgtgacccggcactggggtccaccgcccggcgagctgtacaccgacaacggcgacatcgtgctcgccgccctgcgcgacgagaacatcgtggtgatggtccagccgccgcgcggtttcggggccaacccggtcgccatctaccacgacccggacctgccgcccagccaccactatctggccgcctaccgctggctggccgacgagttcggcgcgcacgcggtggtgcacgtcggcaagcacggcaacctggagtggctgcccggcaagaacgtcggcatgtccgcatcggacggcaccgacgcggcgctcggtgacctgccgctgatctatcccttcctggtcaacgaccccggggagggcacccaggcgaagcgccgcgcgcacgccaccctggtcgatcacctgattccgccgatggcccgggccgagtcgtacggcgacatcgcccgcctggagcagctgctggacgagcacgcgaacatcgccgcgctcgacccggccaagctgccggccatccgggcgcagatctggacgctgatccaggccgccaagatggatcacgacctcggtcaggcgcaccggccggacgacgaagagttcgacgacttcatcatgcacatcgacggatggctgtgtgaggtcaaggacgtgcagatccgcgacggcctgcacgtgctgggcgccgcgccgcagggcgaggcccggatcaacctggtcctggcgatgctgcgggcccgccagatgtgggccggccaggtcgccgcgctgcccggtctgcgcgaggcgctcggcctcgccgaggacgccccgatcgcgcgcgtcgacgagatcgaggccgaagccaggcgcctggtcaccgcgatggaggacgggggctggccggccgatgtatcggcgatctcggatgttccgcaagtgcgggacgtgctgcggttcgcggcgaccgaggtggtgccgcggctgagccgcaccaccgacgagctgaccaacgtgctgcacgcgctgaacggcggctacgtcccggccggtccgagcggctccccgctgcgcggcctgatcaacgtgctgcccaccggccgtaacttctactcggtcgacccgaaggcgatccccagcgcgctggcctgggagaccggccaggcgatggccgactcgctgctggcccgctaccgggccgactacggcgactggccgaaatcggtcggcctgtccgcgtggggtaccagcgcgatgcgcaccgccggcgacgacatcgccgaggtgttcgccctcatcggcgtacgcccgatctgggatcccgcctcgcgccgggtgaccggcctggagccgatcgcgcgcgaggagctgggtcggccccggatcgacgtcacggtccgcatctccggcttcttccgggacgccttcccgcacgtggtggcgatgctcgacgacgccttccggatgatcgccgagctggacgagccggacaaccacgtccgcgagcacgcgctgcgtgaccgggccgagcacggcgactggcggcgggccacgatgcggatcttcgggtcccgcccgggggcgtacggcgccggcatcctgccgctgctggacagccggaactggcgggacgacgcggacctggccgaggtgtacgcggtgtggggcggcttcgcctacgggcgggacctggacggggtgccggcccgcggcgacatggagaacgcgtaccgccggatcgatgtcgccgccaagaacatcgacacccgcgagcacgacatcgccgactcggacgactacttccagtaccacggcggcatgatcgccacggtgcgggcgctgaccggccgggcgcccgccgcgtacatcggcgattccaccaacccggacgccgcgcggacccgcagcctgaccgaggagaccgcgcggatcttccgcgcccgggtggtgaacccccgctggatcgccgcgatgcgccggcacggctacaagggcgccttcgagctggccgccaccgtcgactatctcttcgggtacgacgcgaccgccggcgtggtgaccgactggatgtacgagcagctggccacgacgtacgcgctggacgccgagaaccaggagttcatgcgccagtcgaacccgtgggcgctgcacggcatcaccgagcgcctgctggaggcggccgagcgcaagctctgggactccccgtcgccggacaccctgaccgcgctccagcagctctacctcgagaccgagggcgacctggaggacgggccggcctaaccccagttcgtcggggcctgctgccgggtggtcacgttgatccggttgaagaagttggtggtggcgatccacagcacgatcgccgccagctgctcctcggtgaagtgcttcgcggcctcgtcccagatcgcgtccggcaccgggtccgggttgtcggccagccgggtggcgtattcggccagggcgagcgcggcccgttccggctcggtgaagtacggcgtctcgcgccacacggcgaccgcgaacagccggtcgtcggtctcaccgttcttgcgcaggccacgtgcgcccgagtcgacgcacgggccgcacccgttgatctggctggcccgcaggtgcaccagctccaggacgacgctcggcacgtgccggcctggctgaccaccgtgaccggccgggtctgcctggacatgctgcgcgcccgcggctcccgccgggaggagccgccggtcgccgagtcacccggggccgaggatccggaacgggacgcggtgctggccgactcggtcggtgcggccctgcacgtcgtcctggagatgctcaccccggcggaacgtctcgccttcgtgctgcacgacctgttcgcggtgtcgttcgacgagatcgcggtggtcgtcggccgcagcccggccgccgcgcggcaactggccagccgggcccggcgccgggtgcacggtggatccccggccggcatggccgatttcgcccggcagcgcaggatcgtggacgcgttcctggcggcggcccgcggcggcgacttcgccggactgctcagcctgctcgacccggacgtcatgctgcgcatggacgactccggggcgcgcctcggcgagggcaccaccgcggagcaggcggcccggttcttctgcgggcgtgcgcacggcgcgatcccggcgaccatcgacggggcggccggggcgttcgtgcggacaccgttcggggcgcggatcgcgctgtccttcacggtggccggcgaccggatcatcgcgatcgacgcgatcatggacccggacgacgcaatcaccatcgagctgctgacctgaccccggtcagtccccggcgcggcggcgcagcaggtaggtgtccatgatccagccgtgccgctcgcgggcctccgcgcgggtcgcgacgatctcgtcgccgacgtccgcgacccggccggaggccagcagctcgtcctcggtgccgacataggcgccccagaagatctcggcctccgggtacgcggtgaacgcctgctgcgcgtccagcatcaccaccacgtcgtcggcgcccgccggccagccctctgccagccgccgcccggtcgtcacctggaacggctggcccacccggttcagcccgacccggtgtttggcggccagcgcggagacgctgctgatcccggggatcaccgcgtactcgaaggtgaccgcgccgcgggccaggatctcgtccaggatcgcgatcgtcgagtcgtagagcgccggatcgccccagaccaggaacgacccggtctcctcatccttgaggtgctcggcgatcagctcctcgatcacctgggagcggcgggagcgccagtcggcgatcgtgccggtgtagtcggccggggtgcggtcccggtccgggtcgcggccctcgacgatccgcttgtgcggatgcgagtacgcccggatgatccgctcccgcaggtcgatcaggctctgcttggcctcacccttgtcgagcaggaagaacacattcgtccggccgatcgccttggccgcctgcagggtcagatggtccgggtcgcccgcgccgatcccgatcacgtagatcttccgcacgccctgagtctgccgcaccgccccggagacgcctcgggtggctcaccctcccccgtgtgagggcgcgccacccgagacgctgtcagggaacctccggccggtgtacgaaggtccagtcggcgccgtcggcggagacccaggcgctgaactcgtcggagtcgctgtcggtcgcgatcatgaagccaccgccgcccagccggtacgcgtcgtggccgagccgtggcccgacccggacgaacgtccgtccctggtcggtgctgcggaacgagccgccggcaccctgcaggatcacggtgcggtcgtcgaccggcagcacggagaccaccggaccgtcggcatccagggtcgcccgatcctcccaggtgacggcgccgtcgacactggcccacagatgcagcagaccctcgtgcatgcgcgtcacgtagacgagccggccgtcgccggtgcagatctgacaccagatggtggagagccccgccccgcggggcagcggcagcggatatcggtaccagcttcgtccgccatccctgctgacctcggcgtccagggcgtccttcccggcgtccatccaccagatcccggcctggggcgacatcaccatcgtcgaggagaagcgggcctgcgacgagaggtacatggtgccgtccccggttgccgggtcgatggcgaccaatccggcctcggtcggctggacccgccagccgaagggcacggtggcgcccgtgtcgaccctggtccgatgccaggtcgcaccggcatccgggctggcccagatgaccggcaggcgctgggcggtcacgacccggggcgcggacagcgccaccaccatgccaccgatcgtgtccgtgacctccgcctgcttgtatatcgcgctgatcggtgccggcagcggaaacttgtgccaggtctttccgcgatcggtggtggacgccagcatctggtggcacccgtcgccgccgcacttctgatattgcaggtacaggtgatcgacgtcgcccgcccgcatctgcgtctggagtccggtcagggtgtcgccggagccgacgggcacccagaagtccggacgggtctgccgatactcgcgcggtgcgaggggacccggcgcgttgcgcgcaacggtggtgcgccacggcgcaaccccggcggtgggcgagggatccggggtgccgcggccggcggcgacccccagggccgtcccgccaccggcggtcagaatcgtggcggcgatcgcggcgaaccaccggctgcggccgcggcggcgatatcgggtggaccgggcgatcacatcgtcgaagtcgggcttggcggcggccgcgaccgctgtcacgaagccgccgaacgggtcagacatgggtgttctccaggtccgtgtcgcggaggaactcggcgagcgcgcggcgcccgcggaacagtcggactttgacgctctcgacgctgatgccgagcatcgtggccacctcggccaccggcagatccgcgatgtggtgcagcaccacggtctcccgggtggcccggggcagccgttgcagcgcggcgaccagcgcgacgtggtccggtgagatggccggggcggggtcggcggcgcgcagccggccggtccgcaccacccggtcgaacagctgacggcggcggtggcgggagcgggccaggttcgccgcgacccgaaacatccaggcctccgggttcgtcgcctgcaggacgccgccgggacgggccaccgcccgggcgaacgcctcctgcaccacgtcctgggcctcggcgaagtcgccggtgatgccgtacagctgggccaccaaccggccggcggacgcggcgtacagctcgcgaaggtcgatgtcggggtccactgcgggcgctcctgccgggaaggggcggggtagatgctcacccatacgactcacggtgggcgcgccaggttacacacgttctcacccgagccggggggctccggtccggcggtcaccgcgggcgaggagaaagccggtcggccgacgagaaaatctggtctccacggactagacattcttcgcgggtgtggtaatgttttctccgttgagagagatcggtcagacgttgacagaggtcggctggagacgccgacgtaacaggccgagcgtcgacgcagggtccggaaatgctcgggcccgctcggtcaccgcggtggatccacatcaccgcgagcgacatggcaagtgcacgacaagaccttgacgtcgttccaggtcagggcaaccgcaggtggggctgatgcagttttcggggctccgcctgatgcagcagggatccgccgcacatgtgcggggccgtgaagtcgcgtgggctccgccatcgacggacagcaccgtgagtgatgagtaactgaggaaagggagggctggacgccgttggatcgcccgccgtcaggacgttgtgccagttctgcgggcggacacaccgtggtcccatcgaagtgaggtggtctccggtcacgcttacgcgatcctcgtaccgtccgctgccgtgcgcggcagggtgcggaaacgagaacccgacgaacctgtcggtagatggtgttttcatcccgtaatcccgggccccggcgcgatgtgcgccggggccctcgttcatgaccggaaggggggcccgctccggtgacgtgcgggccggcgccacggcctgtgctacggttcgtttgttgcagttttgatttccgtagacgttttccgcgcctgatggggttatctgaaaccctcgcaggcgcttttttcgtttgtcgtgtcggttcggcgcgggcgatcaacgcggtgacgtgcgagtccgcataccgcggtctccaacagcctgcgaaggagcagacatggctaccggtaccgtgaagtggttcaacagtgacaagggtttcggcttcatcgcgcaggacggtggcggccccgacgtcttcgcccacttctccgcgatcgcgtcgagcggcttccgcagcctcgacgagaaccagaaggtggagttcgacatcacccagggtcagaagggcccgcaggcggagaacatccgcccgatctgatcttcgattgcgcgaacggcggcctgactggttcagcgggccgccgttcggcgtttccggcgaagcgactccctgccgggcaggtacgcggaagtgactatctgccggcggatccgcgcacagcacgctcttcgccgggccggtccgcgcgggggactgcagggtctgcgggagtgacgctcagtcgggcaggatcgggaccgacgggttcatctcgcggcccagcatgtcggcgcggcgcagggcggacgcgccgaaccggtcgcgcacccggtcgaccgcggcgtccagcccgtcctgccgcggggcctcgaacggcagctccagctggacgccaccctcgccgtccagattgctcaccgcgaccccgatcagggtcagcccgcgctggtcgatcagcggccgggcctcgcgcagcaggtcggtcgcgagccgcagcaccgcgccggtctgcagggtcgccttgagcaggctgcgggagcgggtgacccgctggaaatcgtcgaaccgcaggcgcagcgtgaccgtccgcccggcccggtgggcgccgcgcatccggtgggtgacccggtcgaccagggcggccagcaccgcctccacatcctccggggcgcgacggccacggccgagcgcgcactgcgccccgatcgagccgcgccggcccccgctgccgacccggcgcgggtcgtggttgtgggcgagcgcgtgcaggtgccgcccggtgttgccgccgagcatcgcgatcagcgcggcctcgccgacccgggcgacgtcgccgaccgtgcggatctgccgttcgcggagccggtcggcggttttcggtccgacgccccagagtttctcgaccgggagcgggtgcaggaaggccagctcgccgccgggcggcacgaccagcagcccgtccggtttgccggccccgctggcgaccttggccaggaatttggtgccggcgacaccgaccgtgatcggcaggccgacgcgggcgcgcacgtcggcgcgcagccgccgggcgatctcctcggccgtgccgctgatccgccgcagcccgtcgacgccgaggaacgcctcgtcgatggagatcggctcgacgatcggcgtggtgtcccggaacaccgcgaacaccgccttgctggccgccgcataggccgtcatgcggggcggcacgacgattgcctgcgggcacagggcccgcgcccgggacaggctcatcggggtgcggacgccgcacgctttcgcctcgtaggacgcggccagcaccacgccgccgccgaccaggacgggccggtcgcgcagcgcgggatcgtcgcgctgctcgaccgacgcgtagaacgagtccaggtcggcatgcaggatcaccaggccattttagtacgtgtgttcgaatcgggggaggggttgcgctgatcacatcgggggcgggaatcgcgtaccggcaatcccggttcgaaaggttgagtcacttacgctcaagctgatggagaacgaggagcccaccatgttgctcaccaccccgaccgtgcgcgacctcgagcgtctcaccgcccgggtcacctcgacccgcgccaccggcgcccggctcgacgcgtaccgcgaggacgacaccttccacatcgacatcgacctgcccggcgtcgaccccgcctcgatcgacatcaccgtcgacggccgggtgctgaccgtccgtgccgagcgcggacgcgccgagcgcgagggcgtccgttacctgatcgccgagcgcccggtgggcccggtcagccgccaggtccacctctccgagaagctggacaccgaccggctcgaggcgcggcacgacaacggcgtgctcaccctcagcatcccggtcctcgaggagcgcaagccccgccggatcgaggtcgccgtcgcgggctagtgctcgaactggatccagttcacgttcatgaactcgctgtcgtccggggccgtgaacgtgaggtagatcgtgtgcgtgccggtcaccgggcgcagcgccgccacgtcggtgcgccaggtctgccacccgccggtgttgctcaccgagagctcgccgaccggggcgttgccgaggccgtccagccggatctgcacccggccggacaccccggcggcggaggccacccggatcttcgccttggtggccggcacctcgccgaagtcgtacttgtcgaagcgcagatggtcgccccggttgatccagccgacgttctgcccgccgctctcgtcctgggtgtcctgcgcctgaatgccggccagctcactggccgactcggcctgcagcaggccgtactccaccggggtgggcgccggcgaactcggcgccggcgtgtcgaccggggccgaggaggccgcggccgtggcggatgcggtcagcgcggccgggaccgcggccggggcggacggcgtgtcctgccagcggccgatgccgtagccgagcagcagcagggcgagaccacccaggccgatcaatgcccggttacggttcgtccaggaacgggtccggtagacggtcggagtgcgctgatccacccggcaagggtagacagccgttcccatcgagcgccgcgactgccggtttcgttacgaaacccgacgccgggtgccggaccggtgacggtgcggcgccgtggcggccggccccgcaccgtctcacggcgcgagttcctccagcatctccaggcccagctcggccgcgcgcaccgggtccgcgtccggcccgccgatccgcggatcccagttgggctcatggaagatctccgtggcgccggcctccgcgaaccgccgcacgcttgcccggatctccgggtaggaagcgccttccggcgcaacggcacggacgatgatgcgtacgtcgtcagcactccggcccgcaccggccgccccggcccggaccagtttcgccccgcgctcgatgtcggccaggctggcccggctgctgctcacccaccccgccgcgagccggccggcccgccgcagtgccacgtccgcgccgccgccgagcaggatcggcgggccaccggcctggaccgggcggggccgcatccggctcggcggcacccggtagaactcgccctcgaagctcgccgtcccctcggcgaacagcgtgcgcagcgccgccagatactcctcggtgcgccgcccgcgcggtgtcgggtccgagccggtcgccgtgaactccggctccgaccagccggtgcccagccccaggtcgagccgtccgccggtgagccggtccagggtgcccgcctgcttggccagcagcgccggtgacacgtacggcaggttgatcaccgagacccccagccggatccgcgaggtgaccgcgccggcccagctcagcgcgacgatcggatcgagcacgctctgatagaccggagccagctcctgctcctcgccgacgagcagccgctggaacgtccacagcccgtggtagccgagctcctcggcccgccgcgccaccgtcgtcagcgtctccgcctcggcccacgccccggacaccggcaacccgaaactgatcagcatgagccaagcctaggccgcccggcccggatggcgggcggcgccgggagcacggcggtgccgcagctactgctgggtagtggggttcctgcagctcatcgggttccggcggagctgtcggcgcgcagtggtggcgtgtccggtgccgggggtgggcttcgaccccgccgacctggggtggtacctggtgggcgtcgccctgccggcgggggtgctcacggcgtacaccgtcggggtgcccaggggtcagagcggcgcgtcagcgccctccaggaagagccgcccggcctcgacggccggcacgggccgggagaagtagtaaccctgggcgaaaccgcagcccatctcccggagcgcggcgagctggccgaactcctcgatgccctcggccaccgtggccatgcccaggctcttgccgagccggacgatggtgtcggtgagcgcggtgtcgccggcgaggacgccgaggcgctcgacgaacgaccggtcgatcttgagggtgtccaccgggaagcggcgcaggtaggccagcgacgagtagccggtgccgaagtcgtcgatggccagggtgaggcccagcgccttgagccggaccaactgctccaggttggcctcggtgtcggtcatcagcaccgactcggtcatctccaggcacagccggtcggccggcatgccggtctcggccagcaccgccgacaccgtctcggcgaagtcctgctggtcgaactggcggaccgagacgttcaccgacatcttcagcggccgcccgtcggccgcctcgctccactcgaccgcctgccggcaggcctcgtgcagcacccagcggccgagcggcacgatcaggccggtggcctcggcgatcgggatgaagtccagcgggttgatcatgccgcgggtcgggtgcggccagcggaccagcgcctcgaaaccgaccaccgcgctggtctccaggtcgatggtgggctggtagtgcaggcgcagttcgtggttctccagcgcggcgcgcaggtcgttctccagctcgagccgctccaccaggccctcgcgcatccgcgggtggaagctggtgaagatgctgccgccggccgccttggcgtggtgcatggccaggtcggcgttgcgcagcagctgctcggccccgtccggctcgttcggctccagcagggccgcggcggccaggccgatgctcgcccgcacgtggatccgccgggcgccgacctcgaccggcagctccaggtcgtccaggatgcgccgggccacgaactcggcctcgtcgccggtggccgcctcgatcagcaccgcgaactcgtcggcgccgaaccgggcgaccaggtcctcggcccgcacgcaggcctggacccggtcggcgatctgcaccagcagctggtcgccggccaggtggccgaggctgtcgttgatccgcttgaagccgtccaggtcgaggtgcagcacggtcaggtcggtggtgcgggccagcgcggcctgcgcccggtcgtggaacagcacgcggttggcgagctgggtcagcgggtcgtggtatgcctcgtgcaccagctgctcctgcagctccttgcgctcgctgatgtcccgggtgttcagcacgaagccgcccacgtgcgggtcgtcgaccaggttcgtgatgatcacctcggacgggcacttgcggccgtcccggtgggtgtgcacgacttcgagggtggccgtggcgtacggccggaccgcgacctgccgcatggcctgggccagccgcatcgccacctcggcgtcgaccaggtcggtgtagcgccggccgacgaacagctccgggccgtacccgaagacgcgcagcatcgactcgctctggaaggtcacccggccgtccgcgtcgatcaccgtgaccacgtccgagctgtgccggaccagcgcgtggaaccgctgctcccgggcgtacagctcggcggtgcgctcgtcgacccgggcctccagggtgcgggtcaggttccggttctccagcagggtcagcacctgacggccgatcagcagcaggatcagcagcgagcgggtccacgtcacgaacgggctgctgtgcccgctgaccaggtggaacagcgcgctggcgaacagtgccgcggtgaccgccgcatacgggaacatcacgccggtggcctgcgcccgggcgctgaactcgctcttgagcggctcggcgtccttcggtcgggcggcgcccacgatgatcaggcagaacccggcgatccaccccatgtcgatcagcgcgccggcctggtagtcgtggatcatccgctggtaggcgtagccgatgtcggagatcgcgaagccgatcacgccgagcccgaagaaggtcaggtcggccgagcagcggtagagcgcccgtcgctgcggcagcatgtagccgatgatggtggccatcacgatgtcgccgagcgggtagctcagggtgaggtagaggtcggtcccggcagtgccgtggcccagccgggggtcgaccacgaacacccagccgaccagcaccagggacgaggcgaccagcagaccgtcgaggacgctgcgggcccggttcgccagcggctgcgcgccgctcggcaggatcaacaggccgagcgggaccagcagcatcaggccggtgaagcccaggtcggcccaggacgggatctgcgggtcaccgccgtgcggaaagaactcggccaccgtgtaactcgcgcccgcgccccagctgaacacgccggcgccgagcaccgcccagccccagcgggcccggccggtgaacagccggctgcgccacacgcaggtgccggcggccaccatcggcaggatcgccagcgcccaggtggagacgtcggcggccagttgccggccaccggcctccgtgccgaccagcaccgcgagcacggccaggaccgcagcgacggcgatgcagacgtggacccagcggcggatgtccaccgggccttccccgttgttgagagtcatctccacgcccccttgtgcgatcaactgggagcatcgggcggccgggtgcccggatgaggaacggcgagggtgcaagacggttagaccattcagaccaggccgtcctggtacgcgatgatcaccagctggacgcggtcacgcacgccgagcttggtgatcgcccgggtgatgtgggtcttcgcggtcagcgggctgatcaccaggcgggcggcgatctcgtcgttggacaggccggtggcgaccagggcgacgacctcacgttcgcggtcggtgagcacggtcagccgatcccgctccggcgtcttgtcggcatattgtgtgaattggccgacgacgcggcgcgtgacgctcggggagagcagcgcgtcgccggccgcgaccacccggacggcggtgcgcaggccgtccgggtcgacctccttggtgaggaagccgctggcacccgcggcgagggcggcgaagacgtactcgtcggtctcgaaggtggtcaggatgatgaccctggtggtgctctccgccgccaggatcgtcctggtggcggcgatgccgtccattccgggcatccggatgtccatcaggatcacgtccgggcgcaggtcccgggcggcccgcaccgcctcgtcgccggtcgacgcctcgccgaccacctcgatgtcccggccgcgccgcagcaggctgcggaagccggcgcggaccagatgctggtcgtcgacgaggagcacggtgatcggcatgtcggtcctctcagtccttcggctcggtgcacggcagggtggcacggaccgcgaaaccgccgtccgcgggtccggcggtcagcgccccgccgagcgccgcgacccgctcccgcatcccggcgatcccgtgcccgtcggtgatcggcccgccgggcgtcccgtcgtcgcgcacgtcgaccagcacaccgtccggcgcgtaccggatcgtcaccgtcgcggtggtggcgccggcgtgccggacggtgttggtcagcgcctcctgcaccacccggtagaccgccccggccaccggcgccggcacctccaccgggtcgccgacctcggtcagcgacacccgcagcccggccgcgcgcacctgctcggccagcggctccagcccggccaggctcggcagggcgcccgcacgcagcacgccgaccagcgacttcaggtcgttcatcgcccggccgcggacctcctgggcgagccgcagcgaggcgcgcgcctcctccgggtcctcgtcgaaggcgtccagcgccacgttcaggtgcacgccgaccacggcgagcgtgtgcgagacgacgtcgtgcaggtcgcgggcgatctccacgcgctcctcgacccgccgccggctgatctccagctcccgccagcggaccgagttgcgccaggcgagcgccgcggcgatcaccgccccggtccacagcatctcgccgccgacctgcgcgaagacccagccggagccgtggcgggtgaccgcccagtcccagccggcgccgaacgacagcaggaccgaggccacgaccacggcggtacgcgggcgaccggccagcacggtcagcaccagcgccgcggtggccggccacacccagccggccgtggtcagcgcggccgagtggaaggcggtgacggtcagtaccgagacgaccagcgtggtgcggggcaggcggcgggccgccaggaccagcagggccagcaggacggctagtgagacggtcatcacactctgtttgttgccgtcggtcatggcgaggccggccggcacgccgaccagcgtcgcggcggcgccgagatagacgaagttcatggtcaggacgctaggggcggcggccggtccaccgcgtcgtccggccgctgtcacccgcatggacgcctcccgcgtacgagctacaccgttcgatgtatgccgtctgcctcgataaggtaatcgagtgaccgccgcggaactgctcgccgcctcgggacgcttcccgatcgcccccggcctgaccgatcgtgagttcaccgacctggaagccgagttcggtttcaccttcgcgcccgaccaccgcgcgttcctcgcggccggcctgcccaccggcatcggctggcccgactggcgcggcgccgaccggaccgcgctgcgctcggcgctgatcgcgccggtcgagggcgtcctgttcgacgtggccgagaatgatttctggtacgaggggtggggcgccccgttcggcgaccgcgtcgccaccgcccgcgccggcctgatgatcgcgccccggatgatccccctctacgcccaccgctacctgccggcggcgatccccgggcatccggtgctgtcgatctaccagaccgacgtgctgtgttacggcgccgacatcggcgactggctgcaccgcgagttcggtctcggccggccggccgaccggcgggtgcgccccaccgtcccgttctggagcgccctggtctcctgaagcccggcgcctcagtccgtcgcgctctcgcggcgcgccttggcccggcgtttaccctcgtgcatggcctgcacccgggccaccgggatggtgtgcccctcggcgatcagcccggcgtccagcggttgcggcgccggcatcgcggccgcccacggatcgtcgtcccgcagcagcgccggcgcggtgtggatggtgaagtcggccggggtcacaccgtccagctcgtcccaggcgaccgggaacgacaccggcacccccggccggatccgcgggctgtaggcggccgccacggtcgccccgccggcccgggtcgcgtccaggaacacccggccgtgccggtcctcgcggatgaacgcggtggtggccagcaccgggtcgatccgctcggcgcgggccgccacggcccgctgcgccgcggcgacgtcctcgggtgccgggtcgccggccagtgggacgaagacgtgcacccccttggagccgctggtcttcaccgcaccgctcagcccggcctcggccagggcctgccggaccagccgcgccgccgccaccgcggccgggaagccgtcgtcctccggcgggtccagatccatgatcaggtgggtctgccggtgcggggcggaggccagcgccagcgccgggtgcagctcgacggcccgctggttgccgagccacagcagggtgcgccggtcgttgccgagcgcgtaggtgacctcgcgatgcgaggcctccgcccagaccgtggtccgcggcacccagtccggcgtgtatttcggcaggttcttctgcatgaaccggtcctgcccgcggagcacccggatcaccgacagcggccggtcccgcagcaccggcagcagccgggcggacatcgcgtccagatagtcgatcagatcccgcttggtggcgcccgccgccgggaagatctcctgatccagattggtcagcgggactccgtcgcgctcctcagccatgcccgccatcatcgcaggaactgcgcggcggcccggaccagcgcggcctgcagagccttgcggtcgtggccggtggtgtacccgtcgagggccttggtgatggccgcctgccagggctgcgagcaggccgaaccgtgcgcgcaggacgggaccggggtggccgacctccaatccgccatcgccgagcgctggtagggcgagaaatccgcggccgggatgtcggtgcgggccgggatcgagcccttcacgctgttgaacgcctgctgcccggccgccgagctgaccgttttcaaccagcactcggtgccgctgatgttgggcgcgccggtcgccatcgtgaacgagtcggccagccactggaaggtcctgccgttgccggggaaggtgaaccagcggtagtcggtggcccccttggccgccaggtcggccgcctcccagtcgcccatcagctgataacccgccttgccgtcgatcagcagccgctcggcctgcggccagtcgagggtgtcccggtcggcgttggcgaacgtgagcagggtggcgaagtcggcgatcgcccgggttaccagcgcgtcgccccacgaggtggcgccggtgaacagcccggcgaaccgttgcgcgcccagatcgctgatcagcaccgcctccagcagcatcagctgggtccagtcgcggcccaccgcgagtggtgcctccaccccggcggcccggagccggccgaggtcggccagcagggcgggcaggtccccgggtgtgccggtgatgccggcccgggcgagcaccgccgggttgctccagaccacgttggcccggtgcaccccgaccgggatcgagtagatccggccgcgcacggtcaggtcgtcgaccaggccggcgggcagcacgccgcgcaggttccacgcggtgtagtaggaggtcagatcctccacctggccggcgtcgatgtagtcggtgagctcggcaccggcgtgcgcctggaaggtgtccggcgggtcgtgccgggccatccgccgggtcagctcctgcttcgcgttcaccccggcgccgccggccaccgcaccgttgcggaaccgctggcccgggcagtccgcggtgaaccggccgaccagcgcgtccagcccggccttctccccaccctcggtccaccaggtgaagacctcgacggtgcgcggcgcgggctcgtcgtggtcggcggaggtgcaggcggcgacggtcagcagcgcggccacggcgaacacggcgaccttacgcatgccgcccagagtattaccgaacggtggaaagcgccggacccacggcgggctccgggagatcccgccgaccgcggaacggcccggccaggacgatcagaccggccgatgcgtacgtcacggtcatcacggtgagagcgagacggttgccgtacgccgtggccagcccaccgccttgaccgcgcgcaatgcccgggccgcgccgcatcggcggacccggacgggcaccgcaccggcgggccagcccgagcaacgatgctgcgcagccaggcgtcggtggcgaacgcgcgggtgccccacggctcggcgcgcgcggccgggctgcccagccaggagcggatcagctctttaccgatgctgtggtgcgcacggcgtactcggtgatcgtgtcatcccgccggagcgcggaccggcccccaaaagcggcaccgcgccccggcgggaccccctcagacctcggcggtgagctcgaagacctgggtggtggggtggccggcgcgctcgtgcacgcgcatcacggcctccttgctcggaccggtgctcaggcagaacaccttgccggcctcggggtccagccaggcgcgctcgaagtgcacgccctcctcaccctcgatcttgaggtcggcgtcgtgcgcggcgttcaactgctgggcggtgacgccgaagaagccgtcgtggacgtccatgaacttcgccatcggtagatcccctcgcggtacgtcccatgtggcggaactgacccgctcagcgtgcccggcgccggcccgtcggacatcggtcataacacctaggaagccggccggccgcccctaaagttccgctgtggccctcaccagtcccgtcctggtcggacggagcgaccagctggacctcgccgggcgccggcacaccgaagccgccgccggcgccggcgagctgctcctgctggccggcgaggcggggatcggcaagacccgcctgctccgcgagatcagcggccgcgccaccgccgccggattcgcggtgatcggcgccgccgccatgcccggcgacctggaggtggccgccggcctgctcgccgacctcggcgcctagctagctagcgcgagggcgccggcggcgacccggaccggcatcggcggctgctggtcgccgacctggtcgagatgatcgaactcgtcgccgcctgcccgcgaccagcgcaccgccgccctgcgcgccgggctgccggacgcgaccggcgtggtggtggcccggctgcacgcggcactggccgcggcgtacatgctggaccgccggctcaccgaagccctcgaccacgggcagcgggcccgcacgatcctcggggacaacgacgacctggacgccaccgtcggctcggtcctgctcttccacggccggctcgacgaaggcatcggcctgctcgaagcggtgatcgcccgggccgtcgccggcaaccacgaacgcgaagccgcccgcgcctaccggatgctcggctcctccgcctcggtgctggtcgaatacgaccgcgcggagcgctggctggccgccggcatcgcctacgccgaacgggtcgaacgctgcaacgaccggcactacatggccgcgcacctggcccacgtccgctgggccaccggcgacttcaccggcgccgccgcccaggcccgggccgccctcgccgacgggcgtggtggcatcaccacccggatcaccgcgctgcacgtcctcggctacgccgccctgcccaccgaccccgtcgccgcccgcacccaactgcgggaagccgccgagctcggcagcggcatgcgcgaactgcagcgggtctcacccgcctggtggggactcgccgaactcgcgctcctggagaacgacccggacgcggcgatcgcccggtgcgaggacggctacgcggcgtcggccgccgtccacgacgccgcctacctctttccgtacgtcgtcaccggcacccgggcctacctggccgccagcggtcccacccgggcccgcgaatgggtcgcccgcaccggcgcgctgctcggcgaccgccggatccccggcaccctcggcgccgtcgaccatgcccggggactcatccacctcgccgaaggccagaccggaaaggcccgcacgtccctcgaacgggcgggtgaattctgggccggccggcggcgggtctgggagaacaccggcgcgctgctcgaccaggcgcggtgcgcccaccggtcccggcgccccggcgaagccgcccggctggtcgccgccgcctggaccacctggggcggaccggtgccggccggctggtcgatcagtcccaccgggaccgccggcacgtcgccgctgaccacgcgcgagctggaggtcgcccggctggtcgccgccggacgcaccgaccgggagatcgccggcaccctggtgatctcgccgcggaccgtcgccgcgcacgtcgagcacatccggaccaaactcggggtgacccggcgcacccagatcgccggatggctggcgacggttgaggcttcgagttaattccatcgtggtccgtcgaacgggccatagctcgtggtctatcgcgaaagcacaatctccggcatgagcgttccggggaacactgtcatcctgctcgtcctgctcagcgcgttcgtgggctgcgtgggatatgcgctggggcggtggcacgaacggcgggagggcggggcggaccgggcggaggcgtaccgggacgggtatgaccacgcggcccgcagcgtgttcagcatggcggcccgggtggcggggcggcggcgggggcggggggcggtgcgggcctccgcggtggtgtcgccgcctgatccgtccgttgctccggtctcctcttcgccggccgctcctgctcctgtttccgctcccgcttctgctgctgccggtcctgttgccgtttccgggatgccccagccggtctccaccggtgcctctgccgaagcgcccctcgccggtgtgccctcttccggtgtgccctcctccggggtggctgcctccggggggcccgccgcaggtgtgtcgttcccggctccggaacccatcgtcgtgccgggccttccggagccggcggctgagggcggggtgcactactcgtcgctgcccgatccgcggtggggcgccgaggagaccgtctcgccgccgccggtgccacgcgcccggcactacgtctccacggcgggcgagacggacaccccggcgccgcgggaaggggccggccggcacaccgtgccggacgaactcgtgcaggcggccacctacaaactcgccgccgaccgggtggcccgagcccgggtaccccggtcatccggtgaaaccaccgatccgtccgaatcagatcagggcgggcggccgtcggtgccgcggccgcggggactgtgaggggtttctgtcataccccggggataggttcccggcatggtcaccgtcgatgatgtgcggcgggtcgcccgggacctgccacgaagcaccgaacacctgatccgggacagggtgaagttccgggtgggcaaaatcgtgtatgtcgcgttctcccgcgacgagacgatcatgggcttcggctatccccgacaggagcgcgacgcgctgatcgccgccgatccggtgacgttccacctgccccgcgagtccgacctgcggttcaactgggtgcaggcctacctggcgcacctcgacgagcaggagatgaccgagctggtgctggaggcgtggcggatgtgcgtgccgaaaaaggtgtggaccgcctacctgccacgcctggcctgactcccgccccggtcctccctgctccgtccgtcgttcggcccgccccgctgcgccgcccgccccgcctccccggtcgtcggttgcacctgcctggaccgctgtgccgtcaccgcgcgccccggctggctgcccggtcttgtcgtcgctgtcggccgagcctcgttacggcttcccagcctccgcccgaccggcttcgctggtccggtcgagtcggttcgtccactggcctgggcatcggtcgggcatgtgtcggggcgggcttgctttcgggtgggggctgtctcgggtcgggcttgtgtcggggcgggcctgcttctgcgtggaggctggtctcaggtcgggcctgtgcctgggcgggcttgctcgtgggtgagggtcggtctcaggtcgggcttgggcgccggcaggggcggttcatgggcggcggccgaggagcagcaggatttcggtgagagggtcggcggacggcgggaccggcagcgccggggcgaaggcggcgcccggggccaggcgggcggcgtcgtcggggacggcgcgggcgatcgggacggtggcggcgaggacggccgggcccgggtggtagggcagatccagtgtgcgggccacatcccagccgtgcacgacgtagtcgaccaggtggaaggtcagggccaggtggcaggggaacgtgcggtcggctgtgaactccggcagatgcacggggcggtccagggcgcccggggcggcgaaggctgcgacgacgtcggcggcggcctcggcgtaccgcgcatcgaagtcggcgccggccggagccgcagcccagtgcgaaagatcccacccgttgccccgggccgccgcggcgaagccgcggtgctgcgccgtcatgtgcccgagcagcgtggccagatcccagccggcgcacggggtcgaacgccgtagatcctcgacggtcgcccgcgcgacgaggtccacggtcgcgcggaccgcctcggcgtggatcgggcgaagatccttaatagtcgtatgcacatgattacgatctaccgccgcgtacgatccgtcaagaggttgccggaaacggcccgccgcggccatggcaagctgcgctggtggaaagggacgacctcggcgcgatggccgcgcggctcggccggcgcctgatcgcgatggaacagccgatcctggcccggcacggggtgtccatgtggggctacgtcgtcctgaacgccctggccgaaaacgcgatccgcacccaggccgcgctcgccaccggtatcggagcggacaagacccgcctcatcccgatcctcgacgacctgcagcagcgcagcctcatcgaccgcgaacccgacccggccgaccgccgcgtccgcctgctcgccctgaccggatccggtcagcggctgcaccgcgcggtacaggccgagatccgcgccgctgaggacgaactgctcgacgaactgccggccgccgaccgcgaaacgttcctgcgggtgctggcgattctggcccgccgcccggacgggaacggcctccgatcggttcagcccagcggctgaggcgaggttcgctccgccgggcggggcctgccggtgggggccggtcagagctttgcggcggctacggcttcctggaggcctcgggcggcgaggcggtcggctcgttcgttctccgggtggccggcgtggcctttgacccagtgccagcggacttcgtggcgccggaccgcggcgtcgaggcgttgccacaggtcgacgttcttgaccggctggcgggcggcggtctgccagccgttggcggcccagcggggcagccacttggtgatgccgtcccggacgtagacgctgtcggtgtagatgtcgacggtgagcggggcgcggttcaacgtttcgagggcccggatcggagccgtcagctccatccggttgttggtggtcggggtggcctcgccgccgcagaggtccttctccgagcggccccagcggaggaccgcgccccagccaccgggcccggggttcggcacgcaggcgccgtcggtgtagatctcgacgatgcggctgtggtcacccatgccgcgaaccataccgaaaccgccggccggcggaacggagcgcgaccggtcggcggtacgggacgggggagccctggtgggacgcgccgcccggtccgaaggagaagggtggccggcacggggagagcaggcccggcggcgcgagacggtggacggggtggaggctgagggttgccgagtgagggatgccatgccagggctgccccgggcggtgtgcggccggggccgccgtaaggtggccggaggcggatcggatgggcggagctcatggtgggtggcgacgtggccgcggtggagatacgggacgtcgtggtgcgctacggcgacacgacggccgtcaaaggggtgtcgctggacgcccggcgcgggcgggtgctggcgctgctcgggcacaacggcgccgggaagacgagcctgctgcaggtgtgtgaggggttccggaaaccggatgcgggcacggcccggatcctgggcatggatccgatcgccgagcatgacgcgctgatgccgcggctcgggatcatgctgcagtccggcggggtctacccgtgggcggccgcgggggagatcctgcggctgttcgcctcgttcgcggccaacccgctcgacaccggcatgctgctcgaccggctcggcctgcggaaggtggaacgcacccggttccgccggctctccgggggcgagcagcagcggctgagcctcgcggtggccctggtcgggcggcccgaactggtcttcctggacgagccgaccgccggaatggacaccgaggcccggcacaccacctggcagctgatcgaggagttgcgcgccgacggtgtctcggtgctgctgaccacgcacctgctcgacgaggcggagcggctggccgacgatgtggtgatcatgcggtccggcgaggtggcggcgaccggcacgccggccgagctgaccgcggcggccgggatcgacctgttggaggtccgcgccgacgcgggcctcgagctgacctccctgagggcgcggcacgaggtggtggagacgtcgccgggggagtatgcgatcaccggcgcgctggacacccgcgcgctggccgacgtgctgggctggttcgccgcggcggacgcgcacgtcaccgcggtgagcagccgccggcgcacgctggaggatgtctacctgtccctgaccggtaaccagagcacggtgggagccacccgatgagcgtcgcgaccgggactttcacgccggcgcccgggcgggcgtcgatgcgtaccgtcatcagccggcagatccggatggagctgctgctcaccgcccgccggggcgaggcggtggtgctggccatgggggtgccgctgctggtgctgctcggcgccgggctgacccatgcgacgaacctgccgaccggcgaccggctcggcttcgtggtgccgggggtgctggcgctgaccgtgatgtcgacggcgttcaccggccaggcgatcaccaccggttacgagcggagttacggggtgctcaagcggctcggcgcctccccgctgacccggcccggcctgctgctggccaagacggcggcggtgctggtgcagatcgtgctgcaggtgctgttcctcgggctggtcggggtgctggtcggctggcgtcccgacctcgccgaggtcctgcccgcggccggggtgaccgtgctggccgcggccgggtacagcggtctggccctgctgctggccagcgtgctgaaaccggagacgacgacgggtgcggccacactgatctacgtgctgatgctgtcggtcggcgggatcatgttcgccgcgcccgacctggggacggcgggatggttcctgctgccgctggccgcgcacgcccaggcgctgcgcgacacgctgatgaacggggcgagcatcccgctgtcgatctggctggccctggccacgtgggcggtggtctggctgaccgcggccgcccgcagcttccgctgggagtaggcgcgtccatcgatcggtggacagccgatgacgcccgcgtggtcgtcgcgccgcaggtgcccggaacgggacgatcgtcggcatggaagcgatagaggtgtcgagcctccgcaaaacctatcgggacaaggaagcggtccgcggcatcgacctggcggtcggccgcggggagatcttcgcgctgctcgggccgaacggggcgggtaagacgaccacggtcgagatcctggaggggcatcgccggcgcgacggcggcaacgtgcgggtgctcggggaggacccgggcacggcggggcgtggctggcgggcccggatcgggatcgtgttgcaggacgccgatgacgccgccgacctcacggtgcgcgagatggtgcggcatgtggccgggttctacccgcagccgcgcccggccgacgaggtgatcgagctggtcgggctgaccgccaagcagaacagcaggatccggacactgtccggtgggcagcggcgccgggtcgatgtggcgctgggcatcgtggggcggcccgaactgctgttcctggacgagccgacgaccggtttcgacccggcggcgcggcggcagttctgggagctgatccgggcgctggccggggacggcaccaccatcctgctcaccacccactatctggacgaggcggaagcgctcgccgaccggctggcggtgctggccgacgggcggatcgtggccgagggcaccccggcgacgctcggcggccgggccgcggccggggcccgggtgtcctggcagcaggacgggcggacccgcaccgaacaggtcgccgaccccagcgatctgatccgggagctggtcgcgaccggtgcggacctgcgcaccctgacgatcacccgccccaccctcgaagacacctacctgaccctgatcggagccgaccgatgagttcgatgagtctcggccggggccacgtggaggtgctgcagttcctgcgggaccggaccgcggtcgtcttcaccttcctgttcccggcgatgctcctgctgctgttcgggacgatcttcggcaacgactacgaccgggccggggcgagcgcggcccaggtctacaccgccagcatgctggcctacggggtgctgaccaccgggttcgtgacgatgggctccgggctggcgctggaccgcgaggacggcacgctgaagcggctgcggggtacgccgttgccggtcacgtcgtacctcatggggaagttgatcctggtattgaccttgagcgtggccgaggcggcgctgatcctgttggtgggcgtggtcgtcttcgacatgccgctgccgccggccagccactgggtgaccttcgcctggctgatgatcctgtcggtgacctgttgctcgctgctcggcgtcgcggtcagcgcggtggtcaggcatgcccgcagcgccggggcgatcctgaacgtgccggtggtggcgctgcagttcatctccggggtgttcatcaatccgatcacccagctgccgtcctggctgatcaccgtggcctcgttcttcccgatcaagtggatggcccagggcttccggtacgtcttcctcccggacagcatgaagtcgctggaggcggccggggcatgggagctgggccgggtcgccgtggtgctcggtgtgtggtgtgtgatcggattggcgctgtgcctggtgaccttccggtggagcgacaaggaccgatgaccgactcggaggccgtgcacgcccgctattcccgctggtgggacacctactttttcgtgatcacggccgccggcgcggccgcggtcgtcacctccggcgccggggcggggcatcggggggtcgcggccgccgcgatcgtggcgatgctgatcgtgcacgccacggtcggctggcgggcggcgcgcggacccgacggaccgttctcgatcgcggtgctcggggtgcaggtcgcgctgttcatgctggcggcggcgagcgcgccggtggcgtcgtggctgctgttcgcggtgatcccgctgatcttccaactggccccggtgcgcctggcgatcggcgcggtggtgctggtcacgctggtgccgccggcggtcgacctggccgccgggaccggcaacctgaagaccgacctggtcatctcggcgatctccgcggggtccggcgtctggctcgggctgtggatcatccgggtgatccggcagagcaccgagcgggcgaatctgatcgccgagctggaggagagccgcgccgaggtggcccggctgtcccacgaggccggggtgaccgccgagcggacccggctggccggggagatccacgacaccctggcgcagggcttcaccagcatcatcacgctgatccaggcgtccgacccggagctgcgggacgagcggctggcgctcgcggtccgcaccgctcgggagaatttggcggagagccgggcgatcgtggccgcgctgtcgccgtccgcgctggatgccgggctgaccgacgcggttcggcggcagaccgcccggttcaccgaggagaccgggctggccgcgagtttccgcaccaccggggagccgcgcgatctggccacgccgatcgaggtggtgctgctgcgcgccacccaggaggcgctgaccaacgtacggcggcatgcccgggcgaacgaggcggcggtgctgctggcatattcgccgtcgtcggtgcgggtcgtggtgcgcgacgacgggtgcggtttcgacaccacgacgaacggcggcttcgggctgcccggcatgcggcagcgggccgagcaggtgggcggcaccctgaccgtgcgcagcgacccggacaccggcaccacgatcgagttggaggttcccgcatgatccggattctgctggtcgacgatcacccggtggtccggatggggttgcgggggatgctcgacgcggaaccggacctcacggtgatcggcgaggcgtcggacggcgccgagggggcggagatcgcgctgcgggaccgccccgacatcgtgctgatggacctgcggatgccgggcgccgacggggtggaggcgaccggccggatcctcgccggcgacccgggcatccgggtgatggtgctgaccacctacgagtccgatcgtgacatcctgcgcgcgatcgaggccggcgccagcggttatctgctcaaggacgcgtcgccggccgacctcgccgacgccgtccgggcggccgcccgcggggagacggtgctcgcgccgagcgtcgcgtcgaccctggtccgccaggttcgcacacccgctccgccggcgctttcggcccgcgagaccgaggtgctgaaactggttgcggccggcctcaccaacgccgacatcggccgacgcctgttcatctccgaggcgaccgtcaagacgcacctgctccgcgtcttcaacaagctcgacgtcgccgaccgcaccgccgccgtgaccaccgccatgcgtcacgaccttctgtgaacccgattgccggtgtacgccgcgcggccgccacccctcaccaccgatgcgcggcgcaacgtcgcgggggttgagaggtcactgcccggtggtacgcgccgagctgctgccatccgacacccatgcgcggcacgacgccgccgggtcggaaagggcgacaccgatgcgcggcgcaacgccgcggccagggaggttttcggggtgaaccgcagccacccgcggacagtgaagggccgcggtgatcgccctggacgcgcagcggccagatcgccgtggcccggcccgcgcgggagcatgcggtccgcaccccggcggatgcgcgtacatgaaaaatttgatcttgaagttggtcggtgtgaagccgcgagggccggggaatccccggccctcgcttcatttcctgctatcgcattcagcggatcccgagggcgcgcttgaacgtgaagaagaggtccgtctgattggtgacgccgaggacgttggcggcctgcgggccgccggcggcgatccggacctcggtgccggtgtgctgctgggagccggtgatgtccgacgtcgcgtagctgatcgtcatggtggcgttgtcgtgcgtgaccagcgtggcggtgtagcccatcgtggcggcctcgacgatctggctggtgtggccgtggtcggcggtgacgaccaccagggtgtcggggtgcttcttctgatagtcgagcgccttcttgatggcggcgtcgaaggcgacggtctcgccgatctgcccgcacgggttggcggcgtggtcctgcttgtcgatggacgcgccctcgatctgcaggaagaagcccttgtcgcggtgccgggtctgccggtccagcacgtcgagcgccttggtggtcatgtcgaccaggtgcggctgcgcggcgttgcgggcgacgttggtggcgcaggtcgacggggcggtaccggtgcgggtcggcgtggggccggtccactccaggtccatgttgttgggggcgaaagcgcccaggatcggcgcggcccaggaggcggcggcgagcccggtggcgtcggtgacgacctggtagccgacgctccgggcctggtcggtgacggtctggcccttgaacctgccggcctgcacggtctggtcgaagtacgccttgcccccgcccagcaggacgtcggggcgggtctgaaccagctgctcggcgatcgagccggcgccgccgttgaccttgtcgttgacggcgcacgcggccatcgactgcgggcccttgcagccgcggtcgacgacgtgcgaggcgagcacggccggggtggcgtcctgcagctcggcggtggtgacgtcaccggtccggtagccggccttcttggccagctccaggatggtcttcaccgggctgccgtcgggcagcacgctgatcgcgccgttgtaggtcttgtgcccggtcgaccagccggtgccggaggcggccgagtcggtcacgtactcgggcagctccgggtgggccttctgcacggcgtaggtggtgtacgcgccggtcagcggcagggtgtccatggccaggcggccgttggcgccgacctggtagttgcgggcgatggtgatctcgctgtcgcccatgccgtcaccgagcagcaggatgacgttgcgggcggtgccgcccttgatggcgtgcagcgcggcccaggtgttgtcccggtgcgaatcgcccgccatcgccatcgaggggatcgcgacgaccgcggcggcggcggccgcgagggccacgcgtcctcggatattcatagttgcgcactccctaatctgattgaccggccccagggcatcagtcccgggcgacgggaaggtttccgtccggtactgatcgggttgacagggcactacgcctgatcgacaggggtcgctgccgggtttcttaggacgaattaggcgttccgccgaaaagagcccgttatgccggttagattacggatggcgtcgcctcacgtggatcttcagtccccgtgttcgcgctgctgagggccgggttccccggtgccccgaccgccccaaggtgcggtacccgaacaggcaacctcgttccgatgacgaggacgcaaagccagggacctccctgctggaggttgcccagccgccgaaggagacaggaagagaatgggtcatcgaccaatccaagcggcgtcgcacgagcgagtgccgttcacgttctggggacgacctcggatccggacagttctggcgaccgtggcagcggccgcggcggccttcgccccggctgtgatggtgcccgcgccggcgctggcagccaacccctccaccgttgacaacctgaccatcaccgatgccgggaactgggaaggcagcaaggtcaccttcacgctgacctacaccggcagctctcctggcgacttcaccatcgccaccgcggcgggctcggcgagctcaggggccagcgacttcaccgccacccccagcaagacctcgatcaccttcccgggcaccgcggccagctcgaacaactcgaccacggtgacggtggacacggcggccgacgcggacaccgccgacgagacgttcagcctggtggccacggacaccctgggcaacaccaagtcgggcaccgggacgatctacgcggtatccgtctacccgaccttcgggctgacgccgtcgacctcgaccgtggcggagaccgcgaccaaggacgcacagggcaacgtcacccagaagacggtgacggtcaccgccacgctgaccgcgccgctaccgcacgacatcagcatcccggtctccacggtcaacggcgcggacgtcgacccgctgaagaacgccacctccgccggtggcgtgctgcgggactacgacgcgctgccggcgaccgcggtgatcaccatcccggcgtacacgtacaccggcaccaccaccgttcagctgtacgacgacaacgtcgacgagacggctaccaatgggcagtccttcaccgtgcaggccacggacacccctgtggtattggcgaccaacgtaggcgcgagcaagagcaccattaccatcaccgatgacgaccctacgccggtggcgtcgatcggcgatgcgacgtccgcggttaccgagggcggggcgctcaacttcccggtgaccctggaccgcccgtccgacgcgaccaacctgtccgtcggctactacaccgcggccggcacgacgatgaccggctcctccgctggcagcccgtcagatgtcaccaccccgggcagcagcaccacgcccaacgtggccacgatcgcggcctactccacgacccggacgatcgcggtgccgaccgacaatgacgtcaacttcgagggcgcggagaacgtcaaagaggtcctgagcagtgccaacagcagtgcggttggcgtaacgatcggcacgaagtcgacgggcgtcggagtcatcaacgacaacgatgcgggcccggcagtcaccctcgcctcggtcagcacatcgccgggagtgttcccggagggcgactcgggcgagagggttcagaaggtcagggttaccgtcgccgcgggtacctaccccgtaccggtgaagatcgactgggcgaccagggacggctccgccactgcgggctccgactacaaggccgcctcgggcagcttcaccattccggccggcacggacaccacgagctggtacggcgacatccccatcaccgtctacggtgacgtggtcaaggagaactcggaaaccttctccatcgacgtcaccagctcgaccagcaccatcggcgcggtcagcggcgacaccaccatcactctcagtgaggcgggggagtcggacgccaagccgaccttcaacgtcggtgacgtctcggtgagcgagggcaacagcggtacctcgttcgcgaaggtgccgatcgtgatgagcggcgcctcgccgtccgacacggttttcaccacgacgttccatgccggcaccgccgtgggcaccagcaacggtgtgcccggtgacaatgactacaccgtccccaccgacagcacggtgacgatcaaggccggcgacacgaccggatacctgagcatcccgatcaacggtgacaccgtctacgagcgggaccaggtcttcagcgtcgacttcaccaccgccagcagcgacgtcaccaacacgaacacgccggacgtccagcacaccgcgcgggtcacgatcggcaacgacgacgcgcagccgacgctgaccttcaacagcagcaacgcgaccgagggccagccgatcaccgtcaccggcaagatcgtcggggtttccgagtacgcgtacaagctgggtctgaccgtgggcggcacggagaccaacgcggccaccacgggcaccgacttcaccgtgccggccagcctggcaaccacgtcgatcgcggtgccggccgggtactccggtgagctgaccgatattccgagcgtcggtggcggctacacctggtcgttcccgacgctggacgaccagatcgacgagccgaccgagggcttcaccgtcaccgcgaacgagaccaccggcgtgccgaccggcttcacgccggctgtcggaacctacaagatcgcggacgacccgctggacctgccgccggcgatcgccatcggcgacacgaccgtgaacgagaaggacggcactgccgaggtgccgatcgacctgaccttcaacggtgacgcgacgtcgaccacgcagaacgtgaccgtccagtacaacacctcggacggcaccgccaaggcgggcaaggactacacgctcaccaagggcactctgacgatcccgccgggcacgatgaagaccagcatcaaggtccccatcatcaacgactcggacatggaggacgacgagaccttctccgtgcggctcagcaacgccaacccgttgggcgcgcagatcaccagtggagactcgaccgtcaccatcaagtcggacgacacggtggcaccggtcaccccgacgctgatgctcaccggtccggcggccggcgccggcgcggtcaccgcgtggggcaaggccaccccgggcaccaaggtcatgctgtacggcgcggccctgcccgagatggacaagaaggacctgaagctgatcgacaccgtgacggccgacgcttccgggatgtacaagttcaagtcgctcacggcgaccaccggctgggcgttctacgtgcaggccgaggtgggcggcgcgacgtcgatccgggtcgtcaagctgaaccagtcgccggggctgacgctctcgacgagcaagggcaagctgggcgtgacggtcaacgggaacccgaaggcctccggccagacggtcaccatccagcgcaagagcggcagcaagtgggtgacggtcggctccggcaagacgacgtcgagcggcttcaagggctcgtacagcttcaagtcgggcaccaagctgacggtgcgggccatggtttcgggcagcagcagcctgggcatcaacgccggctactcgtccagcaaggccatcaccatcaagtagtcatcacctgacccgaaacagcgggggcggccatccggccgcccccgctcccttttgctggtgccgtgttgctcggtcttgccggtgccgtgttgctcggtcttgtcggtgccgcgttgctcggtcttgtcggtgccgcgttgctcggtcctgctggtgccgcgtcgctcggtcctgctggtgccgtgccgtggtgctcagtcgacctcggcgacggcctgggcgaactgcgccgagtagaggcgcgcgtaagccccctcggccgcgatcagctcgtcgtgggtgccctgttcgacgatggtgccgttctccatgaccaggatcaggtcggcgtcgcggatggtggagagccggtgcgcgatgacgaagctggtccggccggtgcgcagggtgttcatcgcccgctggatcagcacctcggtgcgggtgtcgaccgagctggtggcctcgtccaggatcaggatgctgggctcggcgaggaacgcccgggcgatcgtgatcagctgtttctgcccggcgctgacgttcgagccctcctcgtcgatcctggtctcgtagccgtccggcagcgtccgcacgaagccgtcgacgtgcgcggcctcggatgcccgcacgatcgccgcctggtcgtggtcgtcggcgccgtacgccaggttctccgcgatcgtcccgccgaacagccaggtgtcctgcagcaccatcccgatctgctcgcgcagctgctcgcgcggcatggtggcgatgtccaccccgtccagggtgatccggccaccggtcacgtcgtagaaccgcatcagcaggttgaccagcgtcgtcttgccggccccggtcgggccgacgatcgccaccgtctggcccggctcgacggccagcgacaggttctcgatcagcggcttgtccggcaggtagcggaacgacacgttctcgaacgcgatccgcccctgcaccggcggcatctcccggacggccggctccgggctctgctcctgcgcatcgagcagggcgaacacccgctcggccgaggcgatgccggactgcaccaggttcgccatgctggccacctgggtcagcggctggctgaactggcgcgagtactggatgaacgcctgcacctcgccgagggtcagcgacccggacgtcacccgcagcgcgccgaccaccgccaccagcacgtagttcacgttgctgatgaacatcatggccggctggatcaggccggagatgaactgggcgcggaagctggaggcgaacaaccggtcgttgtgctcgcggaacgtgccctccgcctcctgctgccggccgaacaccttgaccagcgagtgtccggtgaacatctcctcgatgtggccgttgagctggccggtcgtcttccactgggcgacgaactggggctgcgcccgcttgccgatgaaagtggtcaggaagaacgacagcgggatggtgaccagcgcgatcagtgcgagcagcggcgagatccagaacatcatgccgagcacgccgaccacggtcagcagtgcggtgaccagctgggcgaaggtctgctgcagggtctgcgcgatgttgtcggtgtcgttggtggcgcggctgagcacctcaccgcgcggctgcttgtcgaaatacgacagcggcagccgggacagcttcgcctcgacctggttgcgcaggtcgtacaccgcggtctgcaccacccgggcggtgatccggccctgcagtacgccgaacacccaggcgaacaggtagaccacgaccacccaggccagcacgtgcatcagcttgtcgaagtcgatgcctcggccggggatcacgtcgttcatcccggccagcaggtcggcgaacttggtgttgccccgctggcgcaggccctcgacggcctgctccttggtcaccccgggcggcagggtccggcccagcatcttgccgaccacgccgttgaagatcacgtcggtggcgtggccgagcaggcgcgggccgagcaccgacaggaagaccgaggccacaccgaacagcagcaccaccccgaccagggcccgttgcggtgcgagcatccgcagcaggcgcttggtggagcccttgaagtcctgcagtttctccggcgggccgccggcccccatcatcatccgggcggccggcgggccgcccatcggccgcgccggcggcctgttcggcgcggtcacgcgtttgcctcctgctcggtgagctgggaaagaacgatttcgcggtacgtcggattgccgtccatgagttcctcgtgcgtgcccgtcccgacgaccctgccgtcgtcgagcaccacgatccggtcggcgtcgcggatggtgctgacccgctgcgccacgatcaccacggtggcgtcggcgatgtggtcggtcagcgcggcccgcaacgctgcgtcggtcgcgtagtcgagagccgagaaggagtcgtcgaacaggtagatctccggccggtgcaccagcgcgcgggcgatcgccagccgctgccgctgcccgccggacacgttggtgccaccctgggcgatgggcgcgtccagccggccgtccatcttctccacgaagctcctggcctgggcgatctccagcgccgcccagagctcgtcgtcggtggcgtccgggttgccgtaccgcaggttggtcgcgatcgtgccggtgaacaggtagggccgctgcggcacgatgccgaccagccgggacagcaggtcggggtcgagctcgcggacgtcgacgccgtcgaccagcacggcgccctcggtcgcgtcgaacagccgcgggatcaggttgagcagggtcgtcttgccgctgccggtggacccgatgatcgcggtaacttcccgcggtcgggcgatgagccgtacgtcggagaggaccggggcctcggccccgggatagtggaaactgaccgcccgcagctccaactcgccgtgccgggtcacctcggtgaccggcgccgcgggcggcgtcaccgacgtctcggtggcggtcacctcctggatccgctcggcgcagacctcggctcgcgggatcatgatgaacatgaaggtggccatcatgatcgacatcaggatctgcatgaggtagctgaggaacgcggtgagcgcgccgacctgcatcgcgccgctgtcgatccggtgcccgccgaaccagagcacggccacgctggacaggttcacgatcagcatgacggtcgggaacatcaacgccatgatcttgccggctctcagcgagacctgggtgacgtcgttgttggccacctcgtaccgtgcctgctcgcgctcgtcgcggacgaacgcccggatcacccggatgccggtgatctgctcgcgcatcacctggttcacccggtcgatcttgacctgcaggctgcggaacagcggccgcatccggctgatgatcaggccgaccacgccgatcaggaccgggatgatcaccagcagcagcccggagagcggcacgtcctggcgcagcgcgagcacgatgccgccgacgcacatgatcggcgccgagaccatcagcgtgaaggtgagcagcaccagcatctggatctgctgcacgtcgttggtggtgcgggtgatcagcgacggcgcgccgaactggccgacctcgcgggccgagaaggtctgcacccgggtgaagatcgactcgcgcaggtcgcggccgaccgccatcgcggtgcgcgccccgaagtagacggcgacgatctgggcggcgatctgcagcacggtgatgccgagcatcccgccgccgatccgcatcacgtagccggtgtcgcccttgatcacgccgttgtcgatgatgtcggcgttcaacgtcggtaggtagagcgtcgcgagcgtctgcaggaactggaagagcacgatcaggccgatcgtgttccagtacggccgcaggtggacgcgaagcagtttcatcagcacttcgctggctccccagatgtggcggacagaatgccgtcgagcagcagcgacgccagctcggcgccgctgaacgcctcgccgtcggcgaacgggccgaacgtgttggcgccgcagtagagcagcagcagccgggccgcctcacccggcgtgacgcgcagccggtcggcgtccggctccagcaccgcggtgaccgcggacagcagcttcccgcgggtcgaggtcatctgctcctgagcgtgcggatcggtctcgccggcgatgaacagccggcgggcggcgtgcatcaggtgcgcgttcgactggaaacgggtgtgcacgatctcggccgcctcgcgcagccggacccgcaggtcggccgagcggtcgatggcggccagcgcgtccagcaccggctgcgggtcgagcgctttcaccaccgagcagaccacgagctcgttcttgttgctgaagacgccgaagatggtgccctcggccaccccggcggcgtgcgcgatcatccgggtgctcaggtcgacaccgtgctcgcgcaacagcgggatggtcgccgcgatcaacgcggcccgccgctcacccggcgccagggccggttgtcgtctccgtcggttctccacgcggcacagcctactgagcgagcactcactcagccactgacttttgtcatggacccgcgtcgaaccggaaacggcacggtggcgtatcaaggagatgtgagtcaacagaagtcgtaccgccgggtcatccgccaggtgaccacgggtttcgccgcgatcctcgtattcctggcgctgatcctgccggaccagatcacccggctcccaccgggcaaccactggtacaccgcgctgctgcggatcccgctggaggcgctgatcgccggcgccgccctgctggtcgtcccggccgcccggtggcgccgccggctggccgccgcgctgggcctgctgctcggcgcgctgaccgtggtcaaactggtcgacatcggattcttcgcgatcctggcccgccggttcgacccggtgctggactggacgctgttcgacgacggctacaacttcctggtcgactcgatgggcaggggcggggcgctcggcgtggcgtccggcgtggtgctgctcgccgtcctcctgatcgccgggatgatctgggcgatgctgcggctcacccaggtggcgctggggcaccgccggctcgcctggagcgggctcggggcggccaccgcggcctggaccgtcctggcactgctcggcacccagctgatcggcggcctgccggtggccgcgcacgccgccgccgacctggcccaggagaccgccctcgcgctgcccaaggacctcgccgacaagcgcgcgttcgtcgccgaggccggcgacgacgcgtaccgggaccgccccgccgaccagttgctcaccgcgttgcgcggcaaggacgtggtggtctcgttcatcgagagctacgggcgtgacgcggtggagaacccggccttcgacggctcggtgctgaccgcgctcgccgacggcgacaagaaactggccgcggccgggttcgccgcccgcagcggcttcctcacctcgtccaccgccggtggcggcagctggctggcgcactcgacgttcctgtccggcatgtgggtcaacaacgagtcccgctaccggagcctgatggccaccgaccggctcaccctgacccgcacgttcaagaacgccggataccgcacggtcggcgtcgagccgggtgtcatctacgcgtggccggagggtgacttctacggctacgaccaggtgtacgacaaggccgcgctgaactatcacggcccgcagttcagctggtcgccgatgcccgaccagtacgcgctggcccagttccagaaggccgagtacagccgcccgaaccgcggcccgctgctcgccgagatcaccctcacctccagccacaccccgtgggccccggtccccggcatgctggactgggaccagctcggcgacggcagcgtctacggcccgatggcgcgtagcaccaacccgaaggacgtctggtcggacgacagcaggatcaagacggagtacgcccggtccatcgcctactcggtggacagcctgatcgggtgggccgccacatacggcgacgacaacctggtgatggtcttcctcggcgaccaccagccggcctccgtcgtggtcggccagaacgccagccacgacgtgccgatcgcgatcgtcgccaaggacccgaaggtcctcgaccggatcgcctcgtggggctggaccggcagcgtcaagccggccccgaccgcgccggtctggccgatgaacaccttccgtgaccgtttcctgcaggccttcgggcccgaaggcgatccgcactagaggctttcctcatccgcccggtaggaagccggccggctgtgccctcggcgcagccggccggccgtacgctcgtgcggtgctcgccgaaccgtcgctgacccaccgcccggaggacggccactccgcgccgctgctgctctggcgttttcccgagcccgtgctggcggcctccacggcggtcctcggcggcggcgtcggccggtgcgagtgggtgatcaacgccagcgtcccgatgtcctacgcccgcccggacccggcgaaccacctcgccgagctggccgccgccctgcacctcaccggccccggcatcggcctgctcaccggcgtcgacgtgcacgacatggtggccaccacggaggacggcgtcgaggtctgcgccaccgtcggcctgggcgccccgatccgggccgccgagccgggcgtgaccggtttcgcccatcaccccggcaccatcaacatcgtcatctggatcccgcagcacctcgcccccggcgctctgctcaacatcgtcgccacggcgaccgaggccaagacccaggcgttgtacgcgttgggcctgcacgccacgggcaccgccaccgacgcgatcgccgtcctctgcccggccgccggccccaccgcggcctacggcggcccgcgctcccgctggggcgccccgatgtcccgcgccgtctacgaagccgtccacaccggcggccacaccaacctgaccaccggccgctcctggtccagccgcgccgccggcccaccggcggatcggcggccgtgaccgcacccgggacgaggtcgagccgccgccgaaaggtcagtggtaggaatgctcgccggccgccaaggggtgggcgaggcggttctccggtggggcgagcgggcaggcccagcgtgggtcgtacgcgcaactcgggttgtagaggtagttgaagtcgaggcggacccggccggggcgcagccactgcaggccgcggccgtgggtgcccttgacggtgtcggtcaggtagcggccgccaccgtacgactgcgtgccgcaggtggtgtcgcggaccggaaggaacagcccgccgccgtaggcggcgatccaccacagggtcagctcaccgaacggcgtctccaggatgccggcgcgacggtagcgcacggcgccgtccggcccgccggtgtcgatggtcagctccccgtccgcttcccgcaccgggacctcgacgatcaggtcgtcgttcggcggaaagtacgacaggcccgcgaagccggcccgctcgtccgccgggatcggcgactgcgggtggccggcgaacaactcgtcccgccgcctgcggaaatccgacagaccgcccggctccagatacatccgggccaccgccgcccggaaatccgccagctccagtgcttccatgccccgacgctaaccccccacccccgacaccctcgggtcagcatcccactcccgcatttcgcccgtcgatgacgagagctccgaaaacagccagcgaagcgaagccgttttcggcgctctcgtcatcgacgatccggggcgaaatgccgccgagccgaaggcgaggccataagcccagccatctcgttgcgcgcgtcacatcgccgctgcattcttggggacgtgccggaacggattagcgaagtcaccgccctgctggctgaggtgctcgcgccgcgggcgccgctcaccgtgatcgtcgacgggggcgatccgggcgcggcggcggatttcgcctcgcggctggccgcggccttcccggcgagcgcgcgggcctggagcatcgacgcggtgctcgggctgaccgggcccggccggggcggcggtttcgattcggcgctgaacgtgctggaaccggccaccgatcaggtgctggtgtatctgcgcggcgggccgcggaacaggttcgcggccggagacggggagcgccgggcccaggtggtgatcgaccaccgcgatccggactggccggtgatccggcacgtgcacccgtcgctggccgatcccgatcggtggtatctgtccgagagccgggccttcttcgcggctcgcgcggcgaactgggacgtcaagttcggtgacgatctgccggcctacgcccgggcggtgcgcgaggccggggtgcggcccggcgacgtggtgctggacgtgggctagctagctagctggacgtgggctgcggcaccgggcgggcgctgccggcgctggccgccgcggccgcgccgggcgggcgggtgatcgggctcgacttcaccccggacatgctggccgaggcggcccgggccggccgggacgcgtccgccacgctgctggtggcggacgcgcgacggttgccgatcgcgaccggtgcggcggacgtgatcttcgcggccgggctgatcaaccacctgccggatccggtggccgggctggccgaactggcccgggtgacccggccgggcgggacgatcgcgatgttccacccggtggggcgggcggcgttggccacccggcacggacgcacgctgcggccggacgagccgctcggcgcggcacggctggcgccgctgctggccggggcggggtgggtgctcacgtcgtacgaggacggtgaagatcgtttcttggccctggcgacccggctctgaaccgctcggcgttcaggcgctgatcagacccagctcggcgaggtgggccgcgaagccgtcgtcgtcgacgccgggcgcccgggcggtggccgcggcgagcacggccgggtgggccgcgccgatcgccaccgagtgcccggccagggccagcatgctcaggtcgttgggcatgtcgccgaaggcgacggtgtgctcgggcgcgatccccagccagtccagggcgcgggccaccccggccgccttgtcgacgcccggcggaccgatctcgaccaggtgcggcgccgcgtaggtcagcgtggcccgctcggcgaacccggcctcggtgagccgggcgaccagctcgtccgagctgagcgaggcgtgccggatcgccgctgcgtacgccggctggtcggtgatgtcggtgagcggcacggaccgccacggctcgggtggcgggctgccgcgcagcgccaggtattccggcgtgaggtcccaggaggccacgccgaacacgctgagcgccgcgcccggcagcgtgcggctgaagtcggccaggtcacgcagctccggtgcgggcagggtgcgctgccacagggtgcggccgccgtcctccggggtccagccgagcgcgccgccgtggcagaccgcgacggtcaggtgcccggcgaacgcaccgagccgggtcaccccgttgcgggtgcgggcggtggcggccagcagcgggatgccgcgatggcgcagctgggcggccgcgttcagggtggccgcgctgaccaggtcgccgcccgcggggacgaccgtgccgtccagatcggtgaccaccgcctgccactgcgtcatgtccggcattcaacatcatgggccggtcgcctgccgccccgtcccacgccacgcccggcgtagcggcccgcttcgcgggttgcttcgccgaccggatttctccgtgctccgcgccacggtgcggacggtcgccgatcttgctgccggcgtggaaggctgtcaccggaaaccgcggagaggggaccacgaatgggcatggtcaaggtggtcggcctggtgctgcacccgcgccgggactgcgggtcggcggtcgacaccatcgtgagctgggcagccgcccgcggggtgaccgtgctcggcctgcccgacgagatcaaccggatcgactgcagcgcggtcgcggtctccgccgaggagatggtcgagcgggccggcctgctcgtcagcctcggcggcgacggcaccatgctgcgcagcatgcgtctggtcgagggccgcaagacgccggtgctcggggtgaacgtgggacggctcgggttcctcgccgaggtcgacctgcccgacctcaaggacgcgctctcctcgatcgacgaccactcgttccgggtggagagccgcaccgcggtgcgcaccgtgctgcccgacgggcggcgggtcaccgcgttcaacgacatcgccctggtccgggtgcccgggcacgggttggccgcggtcggcatccgggtcgagggcaagcggttcgtcaactacgcggccgacgcggtgctggtctccaccccgaccggctcgacggcgtacagcttctcggccggcggcccgatcgtctcaccgaacgtcgagggcctgatcgtcagcgccgccgccgcacactcgtcgttcaaccgctcgctggtcctggacacctccgaacacctcagcctcgacgtgctgcccaccagcggccggctggcgatcgaggtcgacgggatcatcgaggggtacgccgagcccggcgccgccgtggagatcgaacccgtgccgggcgccgcgcaggtgatccggttcggcgagacctcgttctacgagcgggcgcgccgcaagctccgggtcgagggcagcgcccaggccggcgactgggacaccggtgacgcggtggtggtcgacagcttcgagcgccagcggtatgaggtgctcgtcggcggcgaggtggccggcatgctgcactaccgccgccacggcgaccgcgtcgagctgctgcacaccgaggtcgaccaggccttctccggtcgcgggctggccggccggctggcctcggcggcgctcgccgacgcccggtcccggtccgtgccggtcaccgccacctgcccgttcgtggccggatacgtcgaacgtcaccctgagttgaccgagctgagctgaggaagatcagacaatgggccaagccgcgattctgaccgtcgacgacgacccctcggtctcccgagccatcgcccgcgacctgcgccgacgctacggcgaccggtatcgggtgatccgggccgggtcggccaccgaggcgctcgacgtgctgaaagagctgaaactgcgcggcggtcgggtcgccgtcatgctcgccgactaccggatgccgcagatgaacggcatcgagttcctggagcaggcgatggacctgttcccgcacgcgcgccgtgccctgctcacggcgtacgcggacaccgacgccgcgatccaggcgatcaacctggtcgacgtcgaccactacctgctcaagccgtgggacccgccggaggagaagctctatccggtcctcgacgcgctgctcgacgcctggcaggccaccggcgaccaggagatgccggacatccggctggtcgggcaccggtggagcgagccgtccttccagatccgcgacttcctggcccgcaacctggtgccgtacaaatacttcggcgccgacgagccggagggccgccgcctgatggaggccgcggacgccggccccgagtcgatcccgctggtggtgaccgccgacgggcgggccctgccccggccgagcgtgcagcaggtggccgaggcggccggcctgtccaccaacccgggccgcgacttctacgacctgatcatcgtgggcggcgggccggccggactgggcgccgccgtctacggcgggtcggagggcctcaagaccctgctgatcgagcggcaggcggtcggcggccaggccggccagagctcccggatcgagaattacctcggcttcccggacgggatctccggcgcgcaactgaccgaccgggcccggcggcaggccgacaagttcgccgccgagacgctcaacacccgcgaggtggtggggttgcgcaccgacggctcggcccgcacgctgaccttcgccgacggtggcgaggtgtcggcacacgcgatcctgctggccaccggtgtctcctaccgtccgctggtcgccgagggcgtggccgggctgaccggctccggtgtcttctacggctcggccgccaccgaggggccggcctgcgcgggcagcgaggtctacatcgtcggcggagccaattcggccggccaggcggcgctcttcttcgcgagatacgcgcgcaaggtcaccctgctggtccgcggtgactccctcgaatcgtcgatgtcgtattacctcatccagcagctggcccaggtgtccaacatcgaggtgcggaccaggtgcgaggtgatcggcgcgcagggcgacgggcacctgcaggcgatcaccatctgcgacagcaagggcgggacgaaagccaccgtcgagtgcggctacctgttcgtcttcatcggggcggagccccgcaccgactggctcggcgacgcggtggaacgcgacgggaaaggcttcgtgcgcaccggctcggatctgctggcgaacggcacgcgtccgcggggatgggatcgcgaccgcgatccgttctatctggagagcagtgttcccggcatcttcgccgccggcgacgtccgggccaactcgatcaaacgggtggcctcggcggtcggtgagggcgcgatggccgtcgcgctggtccatcgttacctggaggcgcagtagccatgaccatcgaagcggacgagatccagctccagccctgcgaaccggggcggctcaccccggccgagctgaaatcgctgttcctgttcgagaagctgaccgacgagcaactcgcctggatcgccgagcacggctgcaccatgcgggtcgccggcggcggcctggtgctgcgcgagggtgatccggccgaccagttcttcgtgctgctcagcggaacgatcgcactgacccgccgggtcgggcaggacgatgtgcagaccagccgcaccgagcagcgcggcgtgtacatgggcgccaccaacgcgtacctgcgcgacgacggcgtgccccagcggtacatggcgtcgatgcgggcgctttccgacgccgagttcttcgtgctctccgccggagacttcggccggctcatgcgcgactggttcccgatggcgatccacctgctggaaggcctggcgctggggatgcgcagctcacaggcggcgatcggcgagcggcagcggctgcaggcgctcggtgcgctctcggccggcctcatgcacgagctgaacaatccggccgcggccgccgcccgggccaccggagcgctccgtgaacgggtcgcggcgatgcggatgaaactcggcaaactggccaagggcaaggtcgcgcccgaccggctgaccgcgctgctggagctccaggaggaggtgatcgagcgggccgcgaaggcgcccgtgcgcaccgccatgcagatcgccgacctggaggacgagctcggcgactggatggacgaacacggcgtgaccagcggctgggacgtcgcgccggtcttcgcgcagggtggcatcgacgccgagtgcctcaccgagatcctggcccggctcgagtcacccgagctgctcgaccaggcgatccactggatcgggtacgcgttggagaccgagcagctgatgagcgacatcgaggacgccaccggccgggtgtcctcactggtcaacgcggccaagcagtattcgcacgtggaccgctcggcgcaccagtggatcgacgtgcacaccgggatcgacagcaccctggtgatgctcgcccacaagatcggcaacggggtccgggtggtgaaagactacgaccggacgctgccgcaggtgccggtccacccggctgagctcaaccaggtgtggaccaacctgatcgacaacgcggtacaggcgatgtccggggcgggcaccctcaccatccgcacctaccgggaggacgaccgggtcgtcgtcgcggtcggcgacaccggaccgggcattcccgacgagatcaagaaacgggtcttcgagccgttcttcaccaccaaaccggtcggtgaggggaccgggctgggcctggacatctcctaccggatcgtggtcaacggccacggcggcgacctgtccctgcagtccgcgccgggcgacaccaggttcctggtgcgcctgccgctgagcgagccggcgtcggcgtagatcggcgggaggcgcctgtcgccggtccccagtatcggggccggcggtgggcggctccccgcggtgcttgattcgtcactttctctgacgacagtcagcgtcgcctctttacgcccgttgcctgccgttgccgttgccttgccctcgccgccgttgccgtcgccgtgggcgggtcggggagtacggatcggcgtggagtcggtcgatgcgacggggcagcgggtactggtcgcggtgaccgaggccgatacgctggccgggtatgtgcccggccggccgcgggctcggtggcgctgaccgttaccggtcacccggaggagccgtggcagcctgccgacgccggcgagatgctcggcgccctcacccgggagtagagattggccacggttgcggtggagacgattgtcgaccttccggcggcgcgcgtgtgggaggcgatcgccgacgtgggggcggtgcacgagcggctcctgccggggcgcgtggtggccgccgagatcgacgggggcttccggaccctgacgatgccgaacggggcgcggatccgcgagctgctcatcgcgatcgatcatgagctgcgccggttcgcctatgcggtggtcgaggggcagggattgccgttgacgtaccaccaggccgcttttcaggttttcgaggtggaggaccaggccaggatcgtctggacgaccgatctgctgccggacgcgctggccggagcggtccgtgcccgcgtcgaacgcggcatcgtggagatgaaagcggtcctggaagcagcgtaggcccgacctggggccaagccggccgaggaccgcacgggagccgagcccgcacggggcgcggtggccgaagtcgcgggagctgagaatcccacggggcgcggtgaccgaggtcgcgcgggagctgagaatcgtgcggggcgcggcggccgagaaaccgcgcgcggcaaggtgaccgaggccgcgcgcggggtggcggctggaggtggggtcgggcggggtcagatgtcggcgaccgtgacccggctggtgcggaaggagatcgtgtccggtgtggcggccatcatgccggcggccaggtcgagcaggtggttgtcccggacgacggtgaatccgtgccgggtgagcagctgcgacatgctttccgggcgccacgtcgaccgccacggttcggcggcccacgggttggcgcggccggtgagccgggccatcccctgcaccacgaaacggccgaaggcggcggatgctgatttagtctggtaattggtgatcaggcggctcccggacggggacagcgaggcgatcgcccgcaccgtggtggtcacctcctccggcgtcaggtacggcaccacgccctcccacacccacgtggtcggcatggcggcgcgatgtccggcggcggccagcgcgtcacccaggcggtcccggccgaaatcgaccgggacgaacaccggcgcccgccccggcagcttccccgcgcggtcgcgtttgtcctgctgggacgcgggctggtcgacctcgaagacatccacctcggcgagctcgggcatccgccaggcacggccgtcgagcccggcgccgaggatcaccacctgcggcgtacggtgttcccggaccgcctcgtcgatcgccaccgtgcgcggcaccatcatctcggcgcagcgcagcaccatctcgtagccgacccggccgttccagtcggccggcaaccgctgctcgcgcaccaggtcgacctgggtccgctcgtcgtcgcggagcagttcccacgcggtcgggtcggcgaaccggccgggcgcgatccgatcgtgtgccgcggccctgccctggcacaccagcaccgcggtctgactggcccgatactccgccatgatccccccaagaacgtcggagccggagcccgcgtgaccgcacggccaccacctccggcgggacgtcacggcgacagctcgggcgtgacgtcaggacagcagcccccgcacatatgccgcctgtccggcatgctgggcgtcatcgtcgtacacgctgaccagccggacccccagggtcaccggcggatcccatctgcggtcgacgatccggtccaggtccgcttcggtcaggcctcgcacaaagttcacggtccgcttgtgtacggcatggtagtactcgatgagcgcggccgcgctctccggaaccacggccgccacctccgccgcggtgtgaccgtaaccggtgtccgacgggtcgggcttgcggccgaagcgccccgcccagtcaccctcgacgtacacctgctcggtgtccaggagctcggcgaggtggctgtcctggacccgggtcaggtgccagaccagccagccgatcgggttggcccccggcgccggcgcccagcgcagctgctccggggtgaggccctgaaccgcggattccaccattgcgggcagccggccgtacgcgtcgtcgagcaggcctgtgacgtccatcggttcagtctccctgctggtcggagtgctgctcggaattctgctgagtgtcggcaccagcaccatcaccggtgcccgcggtcgccgtgtccgaccccggggtgctcccggtgccgccggtctgctccggctgcggtgccttcgtcgtcgcggtcgggccggggccggaatccgcgggggcggtggtcccggcgggcttggccgtctgatcggaaccggtcgcagtggtggagggcgaaggtgccggagcctgctttttgtcggtggtgtgcctaccgctccagtggaacacggtcggcgccccgctgtcccgcccgctcgtggcatccgccgcggagcggccggccagcagctcggccgtggtcagcgtgcccagcgccagcaggaacagcgcaccggccacgagcaggatccgcttccagtggatccgccgggacgggccggccggcgcgtcggccggtgcggccggggccgcggccacctcgggggtgccgatggcggccggcgcggtcacgaacgcggcctgcagcttccgggtgccgtggtgcacgaaatgccggtagatctcggtgccgaccgaactgatcaggctgaccagggccgcgccggccagggtgccggccacaccgaggaaggatccgatcaccgcggcggagaccgcggccagggtgccggcgatggtcttcgggatgtcgatgccgtcccagatccgggcttgcgcgcgctcggtcatgtgccccctctcagtcgcgccagccctcctccttcaccgctcgggaggcggccaaaacccgtcgttcggcgagggccacgcgcagcggccggatcacgatgccttcctcctgctccagccggcgacgggccagtttccgggtgcgcaggatgccggtcagaccggccgcggccaccaggaactgcaccgacatcgcgacccggaagtcggcgatgtgatagtcggcactcccaccggtgcgggcgtccaggatcagcccgatcagctcgatggtgagcagggacgcgacgaagccgccgacgttgaccacgccggtcgcggtgcccaggcggtgcggcgggttgaaggtgcgcgcgtagtcgaagccgatcatcgagcccggaccgcccgacccgagagcgacgaccagcaggatcagcaccggcagcggcgcccggccgggccagagcaggaccagcgcccaggcgcccaggttcaccgcgatgatgccgagcaccagcagcgaccggcgcagcgggtagcgctgcaccagcgtgccgagcaccgggccggccgccatgccggtgatcacgaagacggtgagcagcgatccggcctcgccgcgggtcagcccctcaccggcgatcaggaacgggatgccccacatgagggcgaacaccgtgccggtgaactgggtggtgaagtgggtccagaggccgagccgggtgcccgggtgccgccaggcgccgctcaggtcggcgccgagctgccgcatgctgaccgggctgccgctgctcatccggcgctccggggtgtcgcgcagggcggccagcgcgaccagcgcgacgaacacgcccgcgccggcggcgctgaggaacgcggtgcgccagcccgggccggccagcagggcggccagcgggatcgccgagatgatctgcccggcctgcccgaccaggccggtgagctgggtcagcaccggcacccggcggggcgggaaccagtgcgggaccaggcgcagcacgctgatgaaggtcatcgcgtcgccggcgccgaccaggatgcgggccagcaccgcgccggtgatcccgtgggcgttcgccatcaggacctggccggcggccatcaccaggccgccgcagaccaccaggcgcagtgatccgaaacggtcgaggagcaggccgaccgggatctgcaggccggcgtagaccagcagctgcagcacggcgaagctggccagggtgccggcgccgacaccgaaccggtgttgcgcgtccagcccggccacgcccagcgaggtgcggtgcaggacggcgatgacgtacgcggcgaggccggcggcccacaccgcccaggcccgggctccgggtcgcagggacatgtggcgccttccactcgcgcgatttacaggatgtttccacccttctccgcaggtcgccgggttgcaacgtgcgtttccccactgccggttgtcggtgtaaccctattgggggtatatggtggtaaccccaagtgccgcggaggtgcgtgcgatgccgaagatcaacgtgtatctgcccgacgagctggccgaggcggtccgggagaccgggctgccggtatcggcgatctgccagcgggccctggagcaggcggtgcgccgggtgaccgcgatccgggagacctcactgggcgagctgtccagcggcgacctcgaggaacgcttcccgctgatgaccggccgtacccggaccgtgctggccctggcggtcgagcgcgcccgggcttcggccgcccgggccgcggcggccggctagctagctaggctcatcgcccggatcgagcgcctggagcagcgcctgcccgcgggcggggagtgaagccgccgcccgtcggccgcgccgggccgaggcggcccctcagcccgaggacgacgacggggcggccgctcggctctcggtcggggatggggcggccgctccgtgctccggtgggggtggggcggccgttcggcccggggacggggatgaggtggctggtcggcgttctcctcgcggcggccaccgtcctattcgtgccggctccgctgatcacctgacagatgcgtggtgagccaggtgacggtctcctgcaggaaggcggcgcgggacgagcggtgcagcaggtcgtggccctcgccggggaagacgacgaggcggtgcggtgcgccgcgggcggcgagggactcggccacctgggtggcctcgatcagcggcacgttggtgtcgttctcgccgtggatgatcagcaggggcgcccgcaggtggtccaggcggtgcacgggggagaggtcgcgcagcaggtcggcgtcggccaccgggtcgccgtacttgctgacggccgcggcggcgatccagggctcggtatagcgatagaacgtcgcaaagtcggacatgccgcagatgtcgatgccgaccgcgaacagatccgggtaggcgcacagcgcggccagggtcagatagccgccgtaggagcgccccatcacgccgagccgcccggcgatcccggagtcgcgcagatggcgggcgcaggaccggacgtcctcgatcgcgtcgtaccgcagcgccccgttgtccgcgttcacgaaggtgtggccgaagccggacgatccgcggacgttggcggcgaacaccgcgatgccgcggcggaccagggattggaagagcggtccgtgcccggggcgttcctgcgcttccgggccgccgtgcagccagatcaccgtgggatgcgcagcggtgccacccggcggcgtgaacagccagccggtcagggtgaggccgtcgtgggcggtgaccttctccagcgtgggacggaccgcgtcgggggcggccggctcggcggagatcgggcggacgttgccaccgtcgcggtcgcaggcccagacgccctgcggctgtcccgggctctccgcggtgaaggcgagcgtcgacccgtcgaaactccagaccggctcggagatcaccgtcccgggcagcggcacggtgaccgaccgcgtcgtcgttcccacggtgggctcgaaagcgcggcccgtgggggaggaggccggcgggacgacgtggtcgagggtgcgcagttcgagggcggattcgccgccgcgcacgttccagagcagggcggcggtgcggccgtccgccgtgatcgcgaaggtttcgagttcgaccggctcggtggtcagcgtttccaccgttccggcggtggcgcggatcagggccgggaactcgcccgcctcgctgcgggcgtagacgcacccgccgcccgggctgaacagagccagctcaccgggggcgatggtctccgacgtaccggcgagaaggttcttgcagaggatccggcgggcgccgcggggcccctgccgcagcagggcgaagcggcccgccgggtcgatgtcgcagagcgagatcaggtcgccggtggcgacgacggtgcgggtgccggtgaccgcgtcgaccagcagggcgtgggtgaggttctcggtgacggccagcagcgggcggccgggcagccagcgcatgttctccgcggtgtcggtgccgaaaccggcgacctggtgcgggtcggagccgtccgggcggaccagccagacctcgtggcgcggggcgccgccgggggtcagccggcaggccagccagcccccgccggaggaccaggcgaccgcggcgaccggctccgggaaggtgatcgcgaaggcccggtcgctgccgaccggctgcacccggacggccggggtgccgccgcggtcggagacgtaggcggcgtgccgcccgtccggggagagggccggtgaccagttgccggcgatctccgacgagatctcggtgaaggccggcagcacggcgacgtcgtcacgctgacgcaaaaggtctccttcagatgttcttgtcctgcagccacatctccagcagcgccagctgccacagctggttcgcgcccagtgtcgtccgcggcgtgttggggtcggccagcagcgcctcgacgtactccgggcggaacagggcccgggcccgggcggccggggcgtgcagggcgtcgcggacccggtccagcatcgcgccttccaggtgccggatgccggggaccgggaagtatcccttcggacggtcgatcacctcgtcgggcaccagcccgcgggccgcgtccttgagcacccccttgccgtccgcggccagcttgtgctccggcgggcaggccgccgcgagttcgaccagctcatggtcgaggaacgggacgcgcgcctccagcccccatgccatggtcatgttgtcgacccgtttcaccgggtcgtcgacgagcatcacctgcgagtcgatccgcagcgccgcgtcgaccgcggtgtccgcgccgggccgggcgaagctctccgcgacgaaggcggcggcgtggtcgcggtcgagcatccaggccgggttgagctgcccgcgcagcgccgcgtgcgggcggtcgaagaactcccgcgcatacgcctcggcggcctgctcgcgcggcaccccggcgagcggtggataccagctgtatccggcgaagatctcatccgcgccctgccctgattgtacgaccttgacatgctgcgcgacgtcttcgctgagcaggtggaaggcgatgcagtcgtggctgaccatcggctcgctcatcgccgccaccgtccggtcgacggccggcaggaaacggtcgtgcccgatcctgatctgatggtgctcggtcccgaactgcttggcgatcaggtccgagtaggcgaactcgtcgccgctctcgccgccggccgcctcgaagccgatgctgaacgtggtgagatcccgctggccctgctcggcgagcagggcgacgaccaggctggagtcgagaccgccggagagcagcacgccgaccggcacgtcggccaccatgcgccgtttcacggcgatgttcagcctctcccggaccgcttccgcccactcgccggcagagcggtcagcggtccgggtgaacgcggctgaccagtacgtccgttccgaccccgtaccgtcggccttgatcacccggaccgtggccgggggcagtttgcggatcccggacaggatggtccgcggcgccggcaccaccgagtggaacgtcatgtagtgctgcagcgccacccggtcgatggtggtgtccaccccgccggcggccagcagcgccggcagggtcgaggcgaagcgcagccgcccgggcgtctcggcgaggtagagcggcttgatcccgagccggtcccgggccagggtgacggtgccggtgtcatgttcggcgatcgcgaaggcgaacatgccgtgcaggtgcgtgacgcagtcggcgccccaccggtggtacgccttgaggatcacctcggtgtccgagccggagacgaacgtgtatccgtgcccgcgcaactcctcgcgcagctcccggtagttgtagacgcagccgttgaagaccacggtcagcccgagcacgtcgtcggtcatcggctgccgcccggcgtcgctcaggtcgatgatccgcagccgccggtgcccgaacgcgatccgcccgtgctcccacacgccctcgccgtccggcccgcgcgactgcagcacgggcagcatccggcggaccgcgtcggtgtccgcgacgcgctccccgtaacagatctcaccggcgattccgcacatacgaccttcccctcaactgagcaaccaggtgtccttggagccgccgccccgggacgaattgacgatcatggagccggccggggcgacccgggtcagtgccgccggggcgaccacgggctgtcggccggtgaagacgaacgcgcgcaggtcgacgtgccggggtgcgagccgctgcccgtcgaagaccgggtgggtggaaagccggaccaggtcctgcgcgacccaccggtgcggggcggcgcggatctgccggcgcagcgcgtccagctcgtcggcggtggcgtgcgggccgatcacgatccggtcgccgccgtacccgtcgaccggcttgcagaccagctcgtccagccgggacagcacctcggcgcgctgctcggcgaccccgcacaggtaggtcggcacatcggcgagcagcggtttctcacccagatagaactcgatcatccggctgacgtacgcgtagaccgccttgtcgtccccgatcccgttgcccagcgcgttggccagtgtcacggtccgcgcgtgcagcgccgccaccaggctggggcccagcggcatcccgtccgcgcccggcgcgtgcaccaggctgtcctcgcccatccgcaggtagatcacgtcgaccggatagcgcttgccgtcgcgcagccggtgcacccggcccccgtcgacgaacagctcggtggtgcgcaccaccggcacgtccatcgcctcggccagcatccggtgctcgaaccaggccgagtcctccgggccctggctgagcacgaccagcgccgggtcgtcgccggcggccggcccggccgcggcgagcagcgcatccttgagcagggccggggtgtcctcgaccggggtcaggttccgcggccggggcagctcgggcaggatgctctcggtcagccggcggttctgcatggcgtacgcgatgccggacggcacccgcaggttgtcctccagcacgcaccagccgccgtccgcgtcccggaccaggtcgacgccggccacctgggcgcgcaccgcgccgccgccgatcagcgcgccgctggcccgcagctcgggtgagccgtcgatcacccactccgggacgatgccctcggcgacgatcgcccggtcgtcgtacacgtcggagaggaacgcgttgagcgcgcggacccgctgggtcagcccggcccgcagctcggcccagtcggcggccggaacgatccgggggaccaggtcgaacgggaacagccgggtggccgcctcgccggccacactgaaggtcaccccgttggcgcgctgctcctcgtcccgcgcgtcctcgcgtttgcgcagcccggtcgcgccgagcgcggtgagcaccggcagcacctcggcgtactcgggggccaccgactccgccgggaacgcctcgtcgccggccacgtcgtacggcagcaatcgatcgggcccggacaggccgccgccggcaacggaggccgccgccgtgccccgggtatcggtgatcagcagatcgacgacgtcggcgatccggccgcgccgggccagggcgcgccgctgccgggcggccgcgctgccccggctcagcgcgcgggcggacaggtcgcagacctgctcccagtcacccagctcctccaggtgcggtcgcagctcgccgaccaggtgctcgatcgcgacggtggccggcaccggcgccggcgtgcggggcaggtcgagcaggtcgccctccaggccggagcgggccgcccgccacatcgcggcgcggtgcagcgggggacgggcgggcggcagcgggacgccggcgcggtgctcgtgctgggcgcgccggaccagggcgcggaacagcccggccagcagcaccacggtgtccacatccgggcaggcgtcggtgacccgcagctccacggtgggcacgtgcgcggacggccggacgtcgaagtagaccatcttcgggtcgctgatcgtctcggacgcgatcaggtcgctgaccagctgctcgtgctcggccgcggagtgcagcacgccgctgtcgccggcggtcggccagcgcatccagaccagcgagcggacgctggcgtacccggagtcctcgcccatccagaacggcgagctggcggagagcgccagcagggcgggcagggccggggcgacccgctgcgccaccgagaccgcctcgtcgcggtccggcaccccgacgtgcacctgggcgccgcagatcagctgctcacggaccagcatctggtattcgtgcagcatccggcggtaccgggtggtcccggtgaccggcagcgcgtccaggtcgaccagcggcacggtgccggccgccaccaggccgaggccgagcgactcggcgaccgccacggcggtccggcgacgctgcgtgatgccttcgcgcagaccgtccagggtggtggtgaccggcgtgttggtctccacgaccgagcggtgcagctcggccgagaagtgcgccgggtcgagtcggtcgaggatctccggggcccgcggggtgagctcgcgcgtcgtcacatcgacgacgtgcagctcctcctccgcgcccagggtcagggactccgccattgctaccgccttcagttcggaagtccgctcagcgttccgatcgggtgtggcagatgtgtcacgtgcccatttccggtcgtcgccaagcatcgtgatcacttcccccgaccggtgggcagtgggtttcgtcgctaccggtaacctcgggcgtcggcatccacaccccagcggaggtcctgatgggcaacgtcgtcgtcatcaccgggtcggccggtctgatcggttccgagtcggtccgtcacttcgccggtctgggcatggacgtggtcggcatcgacaacgacatgcgcggttacttcttcggcgccgacgggtccaccaagtggaacctggagcggctgaccaccgagatcggcccgcgctacacccactactcgctggacatccgcgaccgtgaggggctcggtaagatcttcgcggagtacggccggagcatcggcctggtgatccacgccgcggcccagccgagccacgactgggcggcccgcgagccgttcaccgacttcgacgtgaacgcggtcggcacgctcaacatgctggaggcggcccgccggcacgcgatcgacgcgccattcatcttcacctcgaccaacaaggtgtacggcgacacgcccaactcgctgccgctggtggagctggacacccggtgggagctgcccgaggaccacaagtggttccagggcatcgacgagacgatgacgatcgacaacagcctgcactcgatcttcggcgccagcaaggtggccgccgacgtgatggtccaggagtacgggcggtacttcgacatgccgaccgcggtcttccggggcggcacgctgaccgggcccggccactcggccgccgagctgcacggcttcctcgcgttcgtcatgcgctgcgtgatggagcagcggaaataccggatcttcggctacaagggcaagcaggtgcgcgacgcgatccactcgcacgacctggtgtccgcgttcgaggcgttccaccgggcgccgcgggtcgccgagatctacaacatgggcggcgggcgcacctcgaactgcagcgtgctggaggcgttcgcgctggcctcggagatcgccgggctgccggccgacaccgagtacgtgccggagaaccgggtcggcgaccaccagtggtgggtcagcagcaccgcacggttcgaggagcactacccggactggaaggtgacgtacgacgtcccgatgatcctgcgggacatgtacgagtcgaaccgggacgtctggaaagcctgaccctcgacttatcggacattaggtatttttacctaatgtccgtactgacgcagttgctgcgccgggacctgccggcgtccgtcgtcgtcttcctgatcgccatcccactctcgctcggcatcgccgcggcgtccggcgccccgctgctcgcgggcctggtcgccgcggtcgtcggcggcatcgtcgcgggtgccctcggcggcgccccgctccaggtcagtggcccggccgcgggcctcaccgtgatcgtggccggcgcggtcgccgaattcggcttcgccggcaccgcggcgatcgtggcggccgccggcctggtccagatcctgctcgggatctcccggctgggccgtgccgccctcgccctgtcacccgccgtcgtgcacggcatgctggccggcatcggcctggtcatcacgctcagccagatccacgtgctgctcggcggcgcgccgcacagcaacgcctgggacaacctgcggcagctccccggccaggtcgccatccaccacgccccggccaccctgctgggtctgctcaccatcgcggtgctgctgctctggccgcgcttcgtgaagatcaccgtgttacccgccgcgctggtggcggtcgccgcggtgaccgcgctggcctgggtgctgggcgccggcgtggtccgggtcgacctgcccgaggaaccgctcgccgagctgatcacgccgatctggccggacgcgccgctgcgccggatcaccgtcgcggtgctcaccatcgcgctggtcgccagcgtcgagtcgctgctgtccgcggtcgcggtcgaccggatgcacgacgggccgcgcgcccggctcaaccgggaactcgtcgcccagggtgcggcgaacacgctctccggactgctcggcggcctgccggtgaccggggtgatcgtgcgcagctcgaccaacgtggcggcgggcgcgcgcagccgggcgtcggcgatcctgcacggggtgtggatcgcagtcttcgtgctgttctgcgcggcgctgctggagaccatcccgatggcggtgctggccgcggtactgatcgtggtcggggtccggctgatcgatccggcgcagatccgcacccacgcccggcaccgggagctgccggcgtatctggtgacggcgtccggggtggtgctcgtcgacctgctcaccggagtggcgctcggggtgctgaccgcggtggcgtggcggcgtgcgtcacggctggcggtcggatcctgatcagcgagccgcaagcactgtcatcgatttctgcgctggccgcaaaagtaggttcagtttttgcaaaggtttgacgtaggattccgtcgtgaccaaacgtcttgccgaggtggcgaagaaggccggggtcagtgaggcgaccgtcagccgggtgctcaacgggcgcgacggcgtctccgaggccacccgggcgtcggtcctgaccgccctcgatgtgctgggctacgagcgacccaccaagctgcggggggagcgggcccgcctggtcggcctggtcctccccgagctgcagaacccgatcttcccggcgctcgccgaggtggtgaccgcctcgctggcccagcgcggcttcaccccggcgctgtgcgcccgcacgatcggcggcgtccccgagtccgactatgtcgagatgctgctcgaccatcaggtctccggcgtgatcttcgcgggcggctcctacgcgctggccgacgcctcacacgagcactaccgccggctgaccgaccgcggcctgccggtggtgctggtcaacgcgggcgtcgacgagctgggcttcccccgggtgtcgacggacgacgcggtggcggtcgagcaggccttcgggcatctgcggtcgctgggccacgagcggatcggcatggtcctcggccccgaggggcacatcccgtcgcgccgcaagctgacctcgatgatccaggtggccggctggaccgacgacaagtgggtggagcgctccagcttctcgatggagggcgcccgggtcgccgcggccaagctgatcgagcgcggcgcgaccgggatcatctgcgccagcgacgtgatggcgctgggcacgatccgggcggcgcgccggctggggcatgccgtgccggctgacgtgtcggtggtcggcttcgacgactcggcgttcatgacctgcaccgatccgccgctgaccacggtgcgtcagccgatcgagacgatgggccagtccgccgtcgacctgctggtcacgcagatcgaggaggcccgggtggtgcgcgacgagctgctcttcgagccggagctggtggtgcgcgggtcgaccggcccggctccgcggtgagcccggtgggcgctgcaggaatcgacaactgaacgcaaccccggaacggctgccgatcgcgtcttgcgatcggcagccttctttttgtcccgatagttgcccgcaaagctgacataccggccccaggccgcctgctgtctatatctgtcgttccaaagtcgtgtctttgcaagacaaaatcgaaaccttgcggaaatcagttggcctcgctacggtgactccactcacagtgctgcggccctgtggctcatcagcatcgatcactcgcagatcagcgaacgccatggataaccgttcccgaagggatggacagatgtccgcaccgcagtaccggaaggccgtggcgttcgcgctcgcggccggcctgggactcagcctcgcggcgtgctccacgaagagcgacgacgagagcaccagcgccgacggcaagacgaccatcacggtggactgcatgccggtcggcaccgagaaggagctggtcgccaactggaacgccgacgtcgccgccttcgagaaggcgaacccgaacatcacgatcaagagcgtgagcgtcggcacccagtgcaacaacccgccggacttcaccgcccggctggccggtggcaccaccaccgacgtcttctacggctacatgaccgacctgcagcaggtgctcgactccggccaggcgatggacatcaccccgtacctgaccgacgagaacgtccccacctggaaggacgtcgacccggcgctcaagcaggtgttcaccgacggcggcaagacctacgcgctgccgatcaagaactactcgatgggcctggtctacaacacggtgctgttcaagaaggccggactggacccggcgaacccgccgaagacctgggccgaggtccgcgccgcggccaagaagatcgtcaccgccgacccggcggtcgccgggtacgccgactacagcgccggcaacaccggtggctggcacttcaccgccgagctgtactcgcagggcggccagatcctgacggccgaccacaagaaggccgacttcaacaacgcgatgggcaagcaggtcctgcagaacctcaaggacatgcgctacgccgacaacagcatgggctcgcgccagctgctgcagtggggcgacctgctgaccaacgccgcggccggcaaagtcggcatgttcatcggcgcgccggacaccacccagcagatcgtctcccagttcaagggcaggtactcggactgggcggtcgctccgctccccggccaggacggcctggccaaggccaccctcggtggcggcgacggctacttcttcaagaagggcctgaccgacgcgcagatcaaggccggcctcaagtgggtcgcctacgagaagctgacggtcggcaagggccagttcgactatccgcgggccaagccgcagaactacccggtgggcctgccccagccgctgctgttcaccagggacagcgcgaccgcgaaggccgagttcgacctgcgcaaggcgaacgccaacgtcgacccggcgatctactcgctcttcgaggcgcagcagctcccgatcaagggcgagccgaccaacgcccaggcgatctacgcggtgctcgactcggcgatgtccggagtgctgaccaacccgaacgccgaccccggcgagctgctcaagaccgccgagcagaaggtcgaccagctgctcgccgccggtagctgatcccgcgaggagtgcgggccggtcccggccggcccgcacccttccgactcatcgcaggagttttccgttggcgaccatcaccgccccgggcacgaccggcaagccggccgcccgcgtcgtccaggcccggaccggcgcgcggcgcagccgcaagatccgcgacaacctcaccgggtacgtcttcctgatcggcgcgatcctctgcttcgccctcttcacctggtatccgatgatccgcgggatcatcatgagcttccagaagaccaggcgcggcgtgaccacctgggtgggcttcgacaactacacccggatcatcgccgacccgagcttctggcccgcctggcgcaacaccgtctacttcaccgtgctggccctggtcatcgggtacgcggtcccgttcttcgtggcgatcctgctcaacgagctccggcacgccaagggctatctgcgggtcctggtgtatctgccggtcatgctgccgccggcctcggcgttgttcctgttcaagttctacgcgtacgacccgggtgacgccggcctgttcaacgcgatcctcaagttcctgcacctgcccacctcgcagtggatgcagtcaccgagcgccacgatgccggccatggtgatcgcctcgacctggatgaacatgggcagcgcggtgctcatctacctggcgtcgctgcagaacatcccgggcgagctgtacgaggcggccgagctggacggcgccgggctctggcgccggatctggaacgtgacgatcccgcagaccaggctgatcctcgggctgctcgcgatgatccagatcgtcgccaccatgcaggtgttcatcgagccgctgatcctggccaacggggccggcacgcaggactcggcgaccaccgtggcgtacctgatctatcagcacggcttctaccagaacgacctcaacggcgccgccgcactcggggtgatcatcctgctggcgctggccgccttctcgggtgtgtacctgcggctcaccacgaagaacgactgaggacggaccagcatgtctcaagattccggcacccggacgctcgtctcgcaggcgcagctgcggcggggcaggggcaggtacgtctactggacgctgctcggcctggtcgtcctggcgttcaccctggtcttcatcggcccgctgtactggatggtgaccggcgcgctcaagaccggtcaggaggtcgcgcagaccccgccgaccctctggccgcggcacccggacgccagcaactacaccaacgcgtggcagaacctgaacctcggcaagctgctgttcaacacgttctactacgcgatcggcgcggtgctgttccagctggtcttcgacaccgcggcggcgtactcgctgtcgaaactgcgcccggtgctgggcaacgtggtgctcggcgcgatgctggccaccctgatgatcccggtgatcgtgctgatcgtcccgcagtacgtgaccgtgatcgacctgccgttcgtgcacaccagcctgatcaaccagccgctggcgatctggctgccgctggtggccaacgcgttcaacatcttcctgttgaagcggttcttcgactccatcccggaggacctgatggcggccgcccaggtggacggcgccggcccgttgcgcacgctctggtcgatcatcctgcccatctcccgcccgatcctcggcgtcgtctcgatcttctcggtgacctacgtctggaaggatttcctctggccgaagctggtcatgccggacccgtcgacccggaccgtgagcgtgggcatcgtggccttctccggtggctcgtcggtcaacgaggtgatcgccgcctcggtgatcgccgccgtcccgaccgtgatcattttcctgatcttccagcgcaacatcatgtccggtctgaccgcgggcagcgtcaagggctgagcatcacccggaaaagggaggcgctcgcctcttaaagcgcaaaaaatgctgcaataatacgcagaaagtgagttctcgtgtccgcaaaagacagtgcgtggtggcgcgacgcggtcatctaccaggtgtatccccggagtttcgccgactccgacggcgacggcgtcggtgacatcaacggcatccgcgcccgcctgggccacctccgcgacctcggggtggacgcgatctggatgagcccgtggtacccgtcgccgatggcggacgccggatacgacgtggccgacttccgcgacgtcgacccggtcttcggcaccctggccggcgccgaggcgctgatcgccgaggcgcacgcggccgggatccggatgatcgtcgacatcgttccgaaccacatctccgccgagcacccgtggttcagggcggcgatcgccgcaccggacgcgcccgagcgggactacttctggttccggcccccgtccgaacggatgcccaccggctggacgggggagttcggtgggaccacctggacgaaggcgccggacggctcctggtacctgcacctgttcaccccggaacagcccgacctcaactgggagcacccggacgtccaggccgagttcgaggacatcctgcggttctggttcgaccggggcgccgacgggatccggatcgactcggccgcgctgctgttcaaggacaccacgctgcccgaggtcgaggagggcaggccgcacccgttccacgacctggacgcggtgcacgacgtctaccgggcctggcggcgggtcgccgacgactacgagggccgggcgctgatcggcgaggtctggatgccggacgtcgagcggttcaccaactacctgcggccggacgagctgcacgcggcgttcaacttcgacttcctcggctgcgcctgggacccggccctgctgcgctcctgcatcgaccgcaccctggacgcgcatgtcaaggtcggcgccccggccacctgggtgctctccaaccatgacgtcacccggcacgtcacccgctacggccggaccgacaccacgttcagcttcgagaacaacctcgacggcaccccggtcgacctggagctcggcacccgacgggcgcgggcggccgcgctgctctccctgtcgctgcccggcgccacctacgtctaccagggcgaggagctgggcctctgggagaacgagaacatcccggaagaacagatccaggatccgatgtacgggcggcgcgggcacacccgggacggctgccgggtgccgctgccctggtcgggcgacgaaccgccgttcgggttcagcagcaccgacccgtggctgccccagccggccgagtggaaggaccgcaccgtggcggcgcagaccggcgacccgaactcgatgctggagctctaccggtcggccatccggctccgcggtgagcatctcgacgaccccgcgatgacctggttcgaccacggcgacgacgtgctggcgtaccaccgcggcgccgatttcgcctgcctgctcaacctctccggcgcacccgttcggctgccggagcaccagaccatcctgctcgccagcggcccgctcgacggtgacctcctcccccgggacaccgcgatctggctgcgcctctaacccggcgggcgacgtccccggttccaccgccgggggcgccgcacggcaggacgaaggaaaccgggggctggccacaccaaggaagggacccatggccaaccgcaccgccccactcctcaccgcagccgtcgtcctcgcggccgcggtcaccacggtgatgtggcaatcacccgcggcgcaagccgccggactgtccccgttcgacgtcgccggacggggcgccaccgtgccgttcaccgagatcgaggccgagaaggccgcgaccaacgggacctccaccggcaccgaccgcacctacggcaccctgtcctcggaggcctccggtcgcgaggcggtcaccctcgacgccgcgggtgaatacgtcgagttcaccctgaccgagccggccgacgcggtcaccttccggtacagcatcccggacggcagaaacgcgtcgctggacctgcgcaccggctcgacgctgatcaggacggtcccggtcacctcgaagtacagctggtactacgggtactacccgttcaccaacaaccccggtgacggccgcccgcaccacttctacgacgaggcccgggcgctgttcggcaccacgtatccggccggcaccaagatccggatccaggtcggctccaccgcgcagtcgcccagcttcaccgtcgacctggccgacttcgagaacgtgccggacccgatcggcaagcccgccggcgccatcgacgcggtcgccgactacggcgcggaccccaccggggccaccgactccaccgcgaagatccaggccgcggtggacgcgggcagcgcctccgggcgggtggtctacgtcccgccggggaactacacgctgtacagccacgtgatcgtggaccgggtgacgctggccggggcgggtccctggtacaccgtgttcggcgggcggcaccccacccagcggaacctggcggccggcatctacggcaggtacgccaaccagggcgggcccagccggaacgtgacggtcaaggacctcgcggtgatcggcgacatccaggagcgggtcgacgaggaccaggtgaacgcgttcggcggcgccctgtcccattcgacgctggacgacgtgtggatgcagcacaccaaggtcggcgcctggatggacggcccgatggaccggttcaccatccggaacagccggatcctggaccagaccgcggacggcgtgaacttccacatgggcgtcaccaactccacggtgaccgacaccttcgtccgcaacaccggtgacgacggcctggccatgtgggcggagagcaccccgaacgtgggcaactcgttcacccacgacaccgtggtggccccgatcctggcgaacaacatcgtcagctacggcggccgggacatcacgatcagcgacaacgtgatggccgagaccgtcaccaacggcggcggcctgcacgtcgccaaccggtacccgggcgtgcagggccccaccgcggtcgccggcacctggacgctggcccgcaacaccctgatccggaccggcaactccgactacaactggaacttcgggatcggcgcgctctggttctggcccgactccggggcgatcaccggtgcgaccctgaacgtcaccgacaccgacatcctggacagctcgtacgccgggatccagtggatcggcaacggcaccagcgggctcaccctgaccaacgtgaccatcgccggggccggcacgttcgcgctgcaggtacaggcgccggccaccgccacgttcaccaacgtgacggcgaccgggatcgcgcagaacccgccgacatacaactgcaccggctccgggctcgcgatcaccgacggcggcggcaactccggctggcagacgccggcgccgtactgcgggccgtggccggcgccgcggtggggcaacagcaccaggcccccgccgacctcttctcccacaccttcgcccccggcgaacggcaacctggcgcagggcagggcggtgaccgccacgtcggccaacgggccgtacgtcgcggcgaacgcggtcgacggcaacgccgccacgtactgggagagcgccaacggcgcgttcccgcagtcgatcaccgtcgacctgggccagaaccgcacgctcgcccgcgtcgtgctcacgctgccgcccgcgacggcctgggccacccggaccgagacgctgtccgtcctgggcagcaccgacggctccaccttcagcacggtcaaggcgagcgccgggtacacgttcgacccggccggcggcaacaccgtcacgattccggtgaccgcgacctcgcgctacctgcgactcaccttcacggggaacaccggctggcccgcgggtcagctgtccgaactcgaggcctacgcctcctgaaaagaaccccggcgggcggccatccaccaggttcgcccgccgggtcccctctgatggaaaggtgcgctcccgcatgtccagattcaggctcatagccgcagcggcggccgcgagcgtggtcgcggcactcgtccacgcccccgcggcgctggccgccggccccaacctggccgccggcaagaccttcagcgccagcagctacaccgacgtctacccggccggcaacgccggggacggcaacgccgacacctactgggagagcagcaacaacgccttcccgcagtggctgcaggtcgacctcggcagtgccaccccggtcaaccaggcggtgctcaagctgccgccggccaccgcctggaacacccgcaccgaaacgctgtcgatcaccggcagcaccgacggcaatgcgttcagcacgctcaaggcgagcgccggctacaccttcaacccgtcctcgggcaacacggtgaccgtcgacctcaccacggtcagcacccggttcctgcggctgaacttcaccgcgaacaccgcgtggccggccggtcagctctccgagctcgaggtgtacggaccggtcagcggcgacagccaggcgcccagcgcgccgtcgaacctgacctggacccagccggccagcgggcagatccggctgaactggaacgcgtcgaccgacaacgtcggcgtgaccggctacgacatctacgccaacggccagctccgcacctcggtggccgggaacgtcctgacctacaccgacagccagcccgactcggcgaccgtggcctactacgtccgggcccgggacgcggccggcaacgtgtccggcaacagcaacgcggtgacccgcaccggcgcgaccggggacacccaggcgccgaccacgcccggcaccctgtcctacaccaccccggcgagcgggcagatccggctcagctggggcgcgtccaccgacaacgtgggcgtgaccggctaccacgtgtacgtcaacgggacgctgaagacgacggtcaccggcaccacgtacaccgacagccagcccgacaccgcgaccgtcgcctactacgtgaaggcgcgcgacgcggccggcaacgagtcggcggccagcaacacggtgacccggaccggcgccccacagaccggcaccaacctggcggtcggcaagccgatcgaggcatcctcgacggtcttcacgttcgtcgccaccaatgccgacgacaacgacaccgccacctactgggagggcagcgcgtacccggcgaacctgaccgtgaagctcggcgcgaacgccggtgtcacctcggtggtggtcaagctcaacccgtccagcgactggggcacccggcagcagacgttcgcggtgctcggccgggaacagtcgtcgtccgcgtacaccaccctggtcggttccacgacgtacaccttcaatcccgcgaccggcaacacggtgaccatcccggtcaccgcgaccacggcggacctgcggttgtccttcaccgccaacaccggcgcgcccagcggccaggtcgccgaactgcaggtgatcggcacgccggcgccgaaccccgacctcaccgtcaccggcatcaccaccgcgccggcctcgccggtcgagaccgacgcgatcacgctgtcggccacggtccgcaacgcgggcacggcggcctcggccgcctcctcggtcaacttctacctgggtacgacgaaggtgggcaccgcctcggtcagcgcactcgcggccggcgccgccaccacggtcaccgcgtcgatcggggcgcgtgatgccggcacctacgccgtctccgcggtcgtcgacgaggccgacacggtgatcgagaccaacgacgccaacaactcctacaacagcccgaccagcctggtcgtcgccccggtcagcagctccgacctggtcgcctcggcggtctcctggtcgccgggcaacccgtcggccggccagaccgtcaccttctcggtgaccctgaggaaccagggcaccgcgcccaccggcagcggcgcccacaccgtcacggtcaccgtcctcaacgggtcgacgacggtcaagacgttcaccgggtcgtacaccggcacgctcgccgccggcgccgcgtccccgtcgatcaacctgggcacctggaccgccgtcaacgggaggtacacggtgcacacggtggtcgccgcggacaccgccgagctgcccgtcaagcagggcaacaacaccagcgacaaggcgttcttcgtcggtcgcggcgccaccatgccgtacgacatgtacgaggccgaggacggcacggtcggtggcggcgcggccgtcgtcggcccgaaccgcaccatcggcgacctggccggcgaggcgtccggccgccgggcggtcaccctcaaccagaccggcgcgtccgtccagtggaccacccggaacgcgaccaacacggtcgtcgcccggttctccatcccggacggcaccaccagttcgatcaacgtgtacgtcaacggcacgctgaacaggacgctggcgctcacctcgaagtacgcctggctgtacggcagcgagacggcgccgcagaactccggcaccggcccgcggcacatctacgacgaggcgaacaccctgctgaccgggtcgttcccggccggcagcacgatcaggctgcagaaggacgcggcgaacagcggcagcatcgcgatcgacttcatccagctggagcaggtcgctccggtcgccgacccggatccctcgaagtacgtggtaccgaccggtttcgaccagcagtcggtgcaggcggccctggacacggctcgtcaggacagcaccaagctcggtgtctacctgccggcgggtgactaccagacgtccaacaagttccaggtgtacgggcgctccttgaagatcatcggcgcgggcccgtggtacacccgcttccacacgccggacacgcagaccgagaccgacgccggcttccgggccgacgccaccgcgaacggctccacgttcgccgacttctcgttctggggcaactacacgatccggatcgacggccccggcaaggtgttcgacttcgcgaacgtctccgggatcaccatcgacgacatctgggccgagcacgtggtctgcctgtactggggcgccaacaccgacaacatggtgatcaggaattcccggatccgggacaccttcgccgacggcatcaacatgaccaacggcagcaccggcaacctggtcgacaacaacgagtcccgcgccaccggcgacgacagcttcgcgctgttctccgccatcgacgccggcggctccgacgagatcaacaacaccttctccaacctcaccagcctgctcacctggcgtgcggccggcatcgcggtctacggcggctacgcgaacacgttcaagaacatctccatcgcggacacgctgtgctactccgggatcacggtcagctcgctggacttcggctacccgatgaacggcttcggcgccaacccgcccaccgtgctcgacaacatctcggtggtccgggccggcggccacttctggggccagcaggtcttcccggccatctggatgttcagcgcctccaaggtcttccagggcatccggatcagcaacgtcgacatcctcgacccgacctactccggcatcatgttccagacccagtacatcggcggcaacccggtcaacccgatcaccgacacggtcttcaccaacgtgacgatcagcggggcgcagcgcagcggggacgccttcgacgcgaagagcggttacgggatctgggcgaacccgctgcccgaagcgggacaggggccggcggtggggtcggcgaccttcaccaacctgacgctgagcaacaactacagggacatcgagaacccgacgacgaccttcaccatcatccggaactgatcaccgggtgagaggcagcgtgcccgcgtccgtcgtccggacgcgggcacgcccatttggaagatccttttgtagggtctgtcgtgcacatcgaattcacccatgcgcggtcgcaggagtactttcaccgcagattcgccggagccgggtccaaggtcgccaggccgttcgcgattcccgcggccatcctcggagtgctgggctggctcgtctgctgcgccgccgggtcggtgcgtagcgagctggcggccggcggggtgctgatcgcggtggcagccgcgctcgccggtgtcgcgttcctgcggtggcggcaagaggtcgtcgtgccggccgactggcgagagccacgcacctacgtgctgaccgacgagagcttcacgtcctggaccgcgaagacatcggccaagcttgcgtggtcggcgttcacctggttgcggcaggaggacgacgcctacctgctgcgcaccatcgccggcaggacctgggacattccgcgagagccgctgaccgcggaacaggacgcggtgctggccgggttcctggccgagctgctggcggcggggtcggcggcccccgctgagcgggatcgatcgtaaagatcgtgggttttccggcggaaacgctccgcggcgggccggtcgggtgggatgttctacgtatcggtagaaagggatcaccacgaaatgaccgactgggatcagggcgacagctggtcgtcgagcagtgcgggccaagaggactggtcggcgcaggaccggcaacgcgactcggcgaaccggttggccaacgtcagcaatgacatggcgaccgccacgcaggccgcggtgcacgcggcggagaccgcggtgcaggtgatccagcggctggaggcgagcagcaccgagatcggcaaggtggtgcagctgatcgcgacgatcgcgaagcagacgaacctgctggcgctgaacgcgacgatcgaggcggcccgggccggtgaggcggggcgcgggttcgccgtggtggccagcgaggtcaaggacctggcgaacgagaccgcgaccgcgacgaacgagatcggcacgcaggtcggcgggatccggaccgacacgcagaacgcggtcgaggcgatccaggagatgcagggcctgatcgaggagctggatcgctgccagaaggtgatcagcgggatcgtggtggagcagcaggccggctgaggcacactgtccggcatggctagtaggagaccgccgagggctcgggcctgcccgtgcgggtcaccggcgtacgcccggtgttgcggaccgctccatgagggcaagccggcggagagcccggaggcgctgatgcggtcgcgcttcagcgcgttcgccctggatctgtccgattacgtccaggccacctggcatccggacacccgccccgcgacgctggagagtgatcccggcctgcgctgggtacgcctcgaggtacgggagacgaccggcggcaccctgttcgacgccgagggcaccgtcacgttccgggcgcatttccgggacaacgggacgcccggggtgctggacgagaagagccgcttcgttcggcacaacgcccgatgggtctatcacagcccggtgtgatctcctgaaacctgaaagaggtaggtgatcaccatgtcggcaacgaggccgatcgaggacgggatcgtccgcgacttcaaggtcaatctctcgtacggggagtatctgcacctcgatgagatcctgggcgcgcagcacccggtgagcgtgcccgagcaccacgacgagctgctgttcatcctgcagcaccagacatccgagctgtggctgaagctgatcatccacgagctgcgcgcggtgctgcgcaacctggccaaggacgacctgaagcccgcgctgaaaggcctggcccgggtcaagcacatccagcggacgctgaccgagcagtggtcggtgctggccaccctcacgcccaccgagtacgcccagttccgcagtttcctgggcacgtcgtcgggtttccagtcgtaccagtaccgcgcggtcgagttcctgctcggcaacaaggaccgcggcatgctgccgatcttcgacgatcagccggccgcccgggaactgctggcggagctgctcggcaccccgagtgtgtacgacgagttcctgcactacctggcccggcacgggcatccggtgccggaggcgatcctggcccgcgacgtgaccgaggcgtacgagtaccagcccgacctggtgccggtcttccagcacatctacgagaaggccgagcagtactgggaggcgtacgaggcctgcgaggaactcgtcgacctggaggagaacttccagctctggcggttccggcacctgaagacggtggaacgcacgatcggtttcaaacgggggacgggcggctccagcggggtcggcttcctgaaggcggctctcgatctgacattcttccccgagctgtacgccgtccgcaccgagatcggagtgccccgttgagccttctcgcccgcgccgccgacctggacgcggccgacccgctggcgaagttccgggagcggttcgtgccggcgccggcggtcgcgtcgtacctggacggcaactcgctgggccgcccgctgatcgcgaccgcccagctgatcgacgagttcgtccgcgaccagtggggcggccggctgatccagggctggaccgacggctggctggagtggccgctgaccctcggtgaccggctcggcgcggtcgcgctgggcgccgcggccgggcagacggtggtcgccgattcgaccaccgtgctgctgtacaagctggcccgggccgcggtcgacgcccggccgggtcgccgtagggtggtgctcgacaccgacaacttcccgaccgaccggtacgtgctggagggcatcgccgcggagcgtgacctcaccctggtctggatcaccaccgacccggtcaccggcatccacccggagcaggtggccgaggtggtcgacgaggacaccgccctggtgctgttctcgcacgtggcgtaccgctccggctggctcgccgacatcccggagatcaaccggatcgcgcacgaggcgggcgcgctgaccctgtgggacctgtgccactcggccggttcggtgccgatccggctcgacgagtggggtgtcgacatcgcggtcggctgctcgtacaagtatctgaacggcggcccgggcgcgcccgccttcgcctacctgcggcgcgaattgcaggacgaggtgcgccagccgatccacggctggatggggcaccgggcggcgttcgagatggggcacggctatgagccggcgcccggcatccgcgcgctgctcagcggcaccccgccgatcctggcgatggtgccgatgcacgccaacctggacatgctcgccgaggccgggatcgacgcggtccgggccaagtcgctgctgctcaccggctatgtgctggagctcgccgacgagtggctgaccccgctcggcgtcgaggtggtcagcccgcgcgacccggcccgccgcggtggtcacatcacgctgcgccgcgccgggttcgagcagctgctcgaacccctctgggccggtggggtgatcccggactatcgccgtccggacgggctgcggatcggcccggcaccgctgagcaccagcttcaccgaggtccaccagggcctcgccacgctgcgcgacctggccgggaagcaccggtgaccgcttccgagacgccgccgtccgaggtctgcgacccggcctcgcctgcggcttcggcgtcgagcccgtgcggtggtgcgggctgcggcggtgccggctgcttcagccgtacgtcgaggtccgctcgtcccggcgaatccgatgccggcggtacgccgaggcccgcccgccccggcgagtcgccgtccgacggtccgccgcggcactcccgctccggccagtcgcggcccaccgtcacccgggttcccgacccgcgtgtcgacgaccggatcgactggttgatcgccgactcggtctggtggggcggccggctgcgccggggtgtggccctccgggtcgccgccgacggtcaggcgaagccggtcccggccgagatggccccgccggacgccgtccgccgtttccccggcacgctgctgcccggcctggtcgacgcccacgtgcacgccgccctggtcgatctcggcacggtccggtccggtggcatcgccgccgtctgggacctcggcggtgtcccggacacgctccgggagctggcggcccggtccgccgagccgggcaccggcctgccccatgtccgctacgccggcccgttcctgaccgcccccggcggctatcccagcgaccggacctgggccccgccgggcagttggcgggagatcacctcggccgccgacgcgggcgccgcggtggccgacgcgtggtcggccggcgccaccctgatcaaggtgaccgcgcacaccggtggcccgaccctgccgcagcccaccctgcgggctctggtcgacgccgcgcacgccgccaccctgccggtcgtggtgcacgccgagggcccgggaacggtcgccgccgccgtcgaagccggcgccgacctgctggcgcacaccccgtggaccgagccgctgccggacgcgctgatccgggcctgtgccgaccggatgacctgggtcagcaccttggacatccacggctggggcagcccggacgcggcgcaggggatcgccgtggacaacctgcgccggttcatcgacgcgggcggcaaggtgcgttacggcaccgacctgggcaacggcccgctgatcccgggcgtcaacccgcgggagctgcgggccctgcgctcggccggcctcacgccggacgagatcctgatcgcgatgaccgaacccggcactcccggcgtgacctggctgcccgccggcctcacgctggccccggacaccttcgccgactccctggccaccgcccgggtcctggacgacagcacccggccgcgcccggcctgacgccggcgtcggcgggtcggtcggttccctgggcgattcgacccggccggaggccggcgtcgaacaggtccgccgggacggttccgccccgccgcatccggcccgaccgcctcccgtgggtggagcgggcaggtcgcgcgtgggcggaaggcggtggccggaaagcagtggtgggtgccgccgggcagtacctcgccgacggcttccggccctcaggccgaccggcagcggccgggcgtcagagggcgacggagcggccggtggaggcggagacgcgggccgcgtcgaggacctccatggcgcgcacggtgtcccacgggtccaccggcagcggcccgttgcccagcaccgcgtcggcgaacgccggatagaacgagtcccaccgaccgcggcagctctccaccggcgccccggtcgtaccgcgccacaggtggccccaccggtgctcgtgttcgacaccccagcggtcgccgagcttggccggggtcttgccggctttcagcatctcctcctggcagtcgagctcggcggagatgtacgtcccggcggtgccggtgacccggaagcgcgggcccgggccggcctgccgccagctgccccacaggtgcgactcgacgccgctgaggtggtgcatggccaggaagaagtcgtcgtcgagctcgccctcgccgcgcacctcggcgtacacccgctgggccgggccgtgcagtttgagtgcctggtcgaccaggtgcgagccgaagtccagcagggtgccgccgccggccgcgggcggcagccggtcgggcgcccagcgttccatccgggactcgaagcgccggatcgtgccgagcgaccccttctcgatcagtttgcgcacggtgaggtaatcggagtcccagcgccggttctgatagacggtcagcgggacgccggccgcctcggcggacttgaccagctcacgggcggtcggcgcgtccagcgcgaagggtttgtcgacgaccacggccaggcccaggcggacggcctcacgggccaggtcggcgtgggtggaggcgggggtcgagatggccacggcccggacgccggcggcggccagggcctcgatcgagtcgtacgcctcgacgccggggagttgctcggcgatctgcttgcggcgttcctcggaggtggtgaccacaccgacgaactcgatgttctccgccgcggcgatcagcggggcgtggaagatccgcccgccgctgccataccccaccagcccgactcgcacccgctcgatcatgccggaagtttttcacatcagttgccgggctgttgcgggtgctcccggcagttacttgtgataacggccgcatgacgtgacgtcacgaaatgtggtatcagcggcgcagtccccgtgcggtgcgcaccacatttccggccggccggacgatctcgtcgcgcagccggcgcccgacggcaccgaccgcccggaaggccggtccgacggcgtgccgcccgacgaacgcgatcgcgatcccggcggggcgcagcaggaaccggtagaccatccgggcggccgcggcgagactgcggccgatcagggcggcggtcccggcgatgccgcggccgatcgggcggaggatccagcggtacgacgcgtccgcggcccacaccagcgcctgcccgagcggggtgagcacccggcggtagaacgtgatcagcacccacgccatcccgtgcccgatcggcgccagcacccagttgtagaccgcctgcccggccggcgcgatcagcacgtgccaggtccaggccagcgcccgcccgagcgggaacagcacgaaccgcccgaggaacaccagcagcggccgcagcaggaatcggaccagctggcgcagcacccaggcgaccccggtgaccagcgccgcgaccagccagcgcagcgcgtgccagaccggcagcagcacccactgcagcagctggcggaccagccggagcagcggcgcgaccaggagcgtgcgcagcagccagcccagggcccggccgaccggccgcaccacgaaccgctggacgagcaccccgagctcccagagcagccggaacgggaagacgacgatcagcgcgacggcccggatcggccaggtgagccaggcgggcgccgcgggcgcgggccgcggcaggggggtggtcatcacgggctcctcgttgctcaagccgttccacggtactggagtgcatccagccggaccgcagtggagcggatccggcggatgggcaggtggcgccccctgtcagatgggtgacgggaccgggatccggggtccgccgcggagaacaatcgcgggatggagccggcgcagcaggaacgcacaccgttcgccgacatcgacggtctgaccgcaccgatgacggacctggtgctgaccgcgctgaccgagatgggccggcatccggagatccgccgggtgcgccgggccgggttcgacgcgttgcgcccggcaccggggatgcggctgctggacgcgggttccggcagtggcgaggtggcccggtcgctggccgccgagaccggcccgcgcggcgaggtgatcgcactggactactcggcggcgatcaccgcggccgcgatcgcccggcacgacggcggcaacgtgcgctatgtcaccggtgacgtcggcgccctggagctgccggacgactgtgtcgacggggtgtggtgcgagcgggtgctgcagcacgtggccgatccggacgcggcggtcgccgagctgcgccgggtgacccggccgggcgggcggctcgtgctgatcgacacggactgggactcgctggccttcgacgggatgccggcgcggctgtgggcggagctgtccgcgtacgccgcccggcatttcaccccgccgcagcgggacatggggcgtacgttgcgccgccgcctggtcgcggccggcctgtccggcctgaccgcgaccccggtgacgtgtctgttcggcagtcccgagtcggcggcggtggtgctgccgatggtcaatccgcgggtgccggccgagacctggcagaccccgcccggcctgcgcgaggagtggctgtcctgcgtcgaggcggccggcgcccgcggcgacttcctcgccgtcctgaccatctgggtggtcaccggcaccgtccagcggtcgaccgctgccaccgggcgggcagagccgtcgccgactatcgttccacggggaccatccggtgcaggaggcggtccagcggcatgctggcgaagctgatccggacgtcgctggaggcgtacggcagccagaaccgcccgtcgtggaccagcccgccgcaggagtagagcacgttcggcacgtacccttcccgctcgatctcgtccgggtcgatcaggccctgcggcaggtcggcgatcaccttggccgggtcgtccaggtcgagcagcatggcgccgatcgcgtaccgccgcatcggcccgaccccgtgggtgagcaccagccagccggcctcggtctcgatcggtgatccgcagttgccgacctggatcaggtcccagccgcggtgcgggacgagcagcggcccggccggctgccagcggtgctggtcgtcgcggacggccaggccgagggtttcgccgtcggagcggcacagggccatcttccggcccttgatgtaccgcgggaacagcgccatgcccttgttgcgcgcggccggcccgtgcagcgcggtcacctcgaaatgccgcaggtcacggctgtagatgacgcgtccggaaatgttgaatccgtcgtacgccgtataggtcgcctggtaggccgggcgaccgtccgggtcgatcacctggacgaaccgcgcgtcctccatgccccggctctcgctcggggtggccggccagaggacccgctggtgcagcggcatggtggccgggaaggtcaccgcgtagtcgtccagcacgatccgccggatcaggtccatcgtcatcggcgtggtgggccgggcctgcagttcgggcggcaggtggctgaggatgtcctcgaattccgcgtcgtcgtagcgttcaggcagcgagttgaggatgtaggccgagcactcgttgtcgatgtcctcgtcgccgagcgccgcgaacagctggtgcttcatgtgcttggcgccgacccgggtgccgatcgcgagcggaccgtcgcggtcctccagacggatcgccgcgcccggcccgatgatcacgctgcagaacccgatagaggagatgtgcccctcgccgatctgccgcaggctcagcgccccgcgcagctcgccgggggccaggtcgctctggtccgggtgcggcaccatcgacgggttgcacagcgccgccgcctcgaccgagaactcgtggctgaagtacgccccgatcagcgtccgggcctgcggcgacagctcgatctccggcggcacccggtgctggaccacctcgtagtggtgctggaagaccgacaggatgtcgtggtgccgcccggagaagcggttcagcacgtcctcgagcagcgtgccgatgtcgttctcgtcgagctgcagcatccgctcgatcatgcaggcggtccggttgtgcgtggcgtgcgcgtcctcgccgggcacgaacagcttgatcaccacgcggcgcccgtcgggctgcatggtgatgttgtgacgggtgatgtcggtggtgttcacagtcgctgtcacgccaaaccgccttgcggtcgggtcgcgctccggatcgccagcgtgcgggcatgctgcagcgtggagacgagcgcgagagtggattcggctccttggttcagattaggaccatcagccgtcaatccgtcataacaaccatgagtctcgctgtcgtacatcaccgttccggtgtcgttgtcgcccaggaaccacgcgatcgcctggaagagcggggcgtcccagcgctcgtcgccggtcaccgcggcggccgtggcgcaggcgtccgcggtggcggccgcctcgatcggctgctggtcgtgccggtgccgggcggagccgggccgccagccgccgaccgggacggtggacaggtggccccggtgctcctgggtccggcacagccaggcgagcatccgcagcccgtcggcgagcagcgcctcgtcgccgagcaggtcgccggccgcgatcaccacctcggccagggccgggttggcgtaggtgagctcgcgttccggccagcaccagtccgggtcggacccgggcaggccgatcaccgtggccgcgtcgccgagcaggtcggcggcgagccggtcgcgcgggtcggcgcggagcacctcggccgcgcccagtccggcgaaggccatcgcccgcggccaggtggagcggcgggtggctccgaggtggaaggcgtaccgcgcctcacgccggatccagccggcggtgctgcgcgcggccgcggtgcccagcccccacagggcgcggccccaccagtcgcccagcgacggctcgtcctgccagcgccggtcatagcccatccggttgcggaacgcgccgtcggcgtcctgggcgtgggtcaggaaggccaggtagcgttcaccggcccggagcacctcgggggccggccggggctcccggctgaccaccagcaggccccgggacacgtcgtcgacgcagtagccgtgctcgcgccggacgatcgcggtgcgcgcgtgttccagcagcccggtgtcgtcggagagccggagcacgtgatcgaagcgcggctccggtacgtcggtgagccggaccggcggcggaatcagccgcagcccctggctcatgccgtgagggtcgcggccggcagcggcacgcggtcggcgagcaggcgggcggccagcgactggtaccgggcggcgaccgccggccagcgcagggtcggcccgccggcgagcccggcgaggcgcccgggcagtccgggctcggccagcacgtgccggatcgcgcaggccatcgcctccgggtcctggtgcggcacgagcagcccggggccgctggccagcaactcgacggcgtgcgggaactcggtggcgaccaccggcaccccggcgcccaccgcctcgatcagcaccccggaggtgacctgctcggtcgagtcgtaggggagcaccaccgcgtccgccgaccggatcagccgggacagttcaccggcgtccaggtaggcatcgagccagcggaccgatgcggtcacgtcgaggtcgtcggcgagcgacttgagcccgtcccggtacacgtcgccctgctgttcgagcaccttcgggtgggtgcggccggcgacggtgtagatcggggccgggctcaggtcgtcgagcagcgcgagggcccgcagcgcccattcgatgcccttgcccgggccgagcaggccccaggtgagcaggtgcggccggtcgtggtcctcgcggggcaccccggcgtggctgccggcgccgtgcgggatcaccgtgatcttgcgagggttcaccgcgtagttcgtggtcagtcgctgccgggcggtgtcggtcatggtcaccacggcatcggcgacctcggcgatctgctccagcaccgcgcgctgcagggtgtcgggttgggtgaggacggtgtgcagcaccacgatggagggcaccttgagcgcgtgcagcagcggcagcacctcggcgccggcgtcacccgggtagatgccgtactcgtgctggatcaccgcgacgtcgaaccggttgagcgcggcggcggcccccgcccagccgccgggcagatcggtgtgccaggtgtgcaccacccggggcgcggcccggtcgagtgcgatgccgccgctggtgttgtcccgggcgagcagccgcaccaccccggatccggcggttgcgccgggcgttccggcggccagatgcatggcgagtgccgcattgaacgtcgccaaaccgcattgtgtgggcggataagtactcaaaaacccgtatgtcgcgggcatgactggcctttctctcctcggccggctgcctccggcgcagcgcggacaccgcgcgcgggcatgactacgggcaccgcgcgtgaacggcgtagaggcgtttcgggaaatgtcccgtttaacgcgcaattcacatggggaccgtaacaagatcaagcttttcagcagacgatttttcggtaaatcgccaggtacgcgtcgaccatccgatccgcgccgaagcgttcccgcgcccgggccgaacaaacccggcgatccagggcggcgacctcgtcgaccgcggccaccgcctcgtcgaccgagccgaccaggcgtccggtgacgccctcgtccaccacctcgggcatggagcccttccggtacgcgatcaccggcgtaccgcagatcatcgattccacgacggagagcccgaacggctcggcgaaccggatcgggtgcagcagcgccgccccggagccgaggatcgcaccgcgctcctcggggccgaccgagccgagatagaccactcggtcgccgtcgatcagcggctcgaccttctcccggaagaatcgccggtcctggacgatcccgcagatcaccagccgccggccggcccgtcgggcgatctcgacggccagatcggtgcccttgtccgggtggatccggccgaacaggatcagatcgtcgccgccggtggtgtgcagcggcagtccgtccaggtcgacgccgtggtgcacggtggccacgtagtccagttccggcgaccggtcgctgtccgagatcgagacgaaccgggacttcgctctccggtacgccgggaggatgttcgccccggagaacccgtgcaccgtggtcagcatcggcgcggcgcagtgtgcggagaacgccagtggtagccagtccaggtggttgtggatcaggtcgaactcgccggagcgggccagcgcgtggctgacgtggatcgcctcccagacccggccgtcgaggctgtcgctctcctcgtacccggtcggcacgacgccgtccagggtggccttggtgaccgagtccagggtggcgaacagggtgacgtccacgccgcgcgcggtcagcccctcggcgagcaggctggtgatcagttcccacgggccgtagtgcaccgggggagtgcgccaggcgatcggcccgagcagcgcgatcttcacgacaaaacacacttttcggtaataagcacgtgatcagtatgcctctccgtcaccgcgcggaaccgcccgttctcgtgttagagaagaccaatgacggattcgtggtggaagaaggcggtcgtctaccagatctatccgcggagcttcgcggactcggacggtgacggcatgggcgacctgcgcgggatcatcggccacctcgaccatctcgccgaactcggcgtggacgtgctctggttgtcgccggtctatccctcgccgcaggacgacaacggttacgacatcagcgactatcagaacatcgagccgatgttcggcaccctggagatcttcgacgagctgctcgccggtgcgcacgcccggggcatgaaaatcgtgatggacctggtggtcaaccacagctcggacgagcacccgtggttcgccgagagccggtcgtcgcgggacaccccgaaacgggactggtactggtggcggccggcccgcgagggcatggagccgggcacgccgggcgccgagccgaccaactggggttcggtgttcggcggcccggcctgggagttcgacgagaagaccggcgagtactacctgcacctgttctcccgtaagcagcccgacctcaactgggagaacccggaggtgcgccaggccgtctacgcgatgatgcggtggtggctggaccggggcgtggacggcttccggatggacgtgatcaacatgatctccaaggtcacgccgctgccggacgggcggctgtcggccggcgccgcatacgcggacggctcggccggcttcgtcggtggcccgcgcctgcacgagttcctcaaggagatgtaccgcgaggtcttcgacggccgcggtgagctgctcaccgtcggcgagatgcccggcgtcacggtcgacgaggcccgggtgcacaccgacccggccgagcacgagatcgacatggtgttccagttcgaccacgtctgggccgaccgcggtcctgacccgtggctgctgcagaaacttcagctgaccaacctcaaggcgatcctcggccggtggcaggccgggctcgccgaggtgggctggaacagcctgtactggaacaaccacgaccagccgcggatcgtctcccgctacggcgacgactcaccggagcaccgggtcgcctcggccaagatgctcggcaccgtgctgcacctgcaccgcggcacgccctacgtctaccagggcgaggagctcgggatgacgaactacccgttccgcggcatcgaggacttccgcgacatcgaggcgctcgggcagtacaagcaggccctggagttggaggggcgcagcgccgaggcggtgctgaccgtgctgcgcgcccgcggccgggacaacgcgcgcaccccgatgcagtgggacgactcgccgcaggccgggttcaccaccggcacgccgtggctggcggtcaacccgaactatccgcagatcaacgcggcggcgcagcgggccgacccggactcggtcttccactactaccgcagactgatcgagctgcggcacaccgagccggccgtcgccctgggcgacttcaccatgctgctgccgcacgacgagcggttgtacgccttcacccgccgcctggacgccaccgagctcctggtgatcggcaacttcaccggcgagaccgtccaggcggagatcgcggacgccgcgtcctgggcgcacgccgacgtgctgatcaccaacgtccccggcgccaccccgcggaacctgaccctggccccctggcaggccgtcgtctacaaacgcacggtctgatccgcgccgccgacggtcaggtgcagcgtggagctgtgccggaccgtcgtgcgggtgggcaccagccgggtggcggtggcggccagtccggcaggtcgcgccactcgtcgacgccgccgacgtggacccggacccgccgctccggcgcgccgccccgcagccgccgcaacgcctgcccgaagacctcggtccatcccgcgctgagcgtgctggtgtgggtccacggcccgatcagcaggtcggtctccaggccggcgtcccggcgtcgccgatagagcgtgactggcgggccgacctactcgcgctctgcgtcatgcagcgcgcgctgatgctggcccacccgtggctgcccggcgtgctggccgggcgccggctgatcgggcgcaatctgctcggcttcctggagcacgggctgcgcgcgctgcagccggccgggctgcccggggtcgccgggatgaccctgctcggcctgctcaccggcttcgtggcgtcctacgtgaccagcgaactggccgacgcctcggacgcggtggcgcagatcggggcggcggtggcgaccggggacttcccgctgctggcccggacgctcggcgagggcgggacgccgctggacttcccgcgcatcgcggactggatgatcaccggtctggtcgagcgggcggaacaccggtaatcgagcttttttcacagaaatggccacaagccactcctgtccccggcaaggtgacacatggtcgccggtacacacccgatctgacccctcccgccggcgcccggggagtaacgcatgcgccgcaaccggctcgccgcccgtctcgtcaccgccctggtcgccgtcaccccggcgatcgccctggccctggtcggtctcggcccggcgccggccggcggtgacccgctgctgcagaccttcgccctcaccggcggcctgcggctggccgcggacggcgccggcgcggacgtcgagcggtccctcccggaacgcgacaccaaaccgttcagcctggtcggggtcacctgggacgacccgcgcgcggtggcggccgggaccatccaggtgcgcacccgcccggccggccgccgcacctggacgccgtggcgcgagctggagaccgacgcgcccgacgagtccggcggccaggccgtccggggcgccagcgacccgctctgggtgggcccgtcggacggtgtgcaggcccgggtgatcgccgccggcgcggcccgggcgctgccggccgggatgcgggtcgacctgatcaacccggacgcccggccggcgccggtggcggacgcgatggcgccggcggcggccgagcggctccgccggatcgccggggtggagatcccggaccggccggtgccgcggatgctgacccgggccgcctggggcgccgacgagcggatggtgcgggagaagcccgcgtacaccggtccggtccaggtgttcttcgtgcaccacacggcgaccggcaacgactacagctgcgggtcgtcgaccagcgtggtccgcggtatccaggcgtaccaggtgaagagcaagggctggaacgacatcggctacaacttcctggtcgacaagtgcggcaccatcttcgaggggcggcgcggcgggatcacccgcaatgtgctcggcgcgcacaccctgggcttcaacaccgacgccagcgcggtcgcggtgatcggcgactaccgcggcaccgcggccggttcggccaccgaggtcgcggtggcccagctcgccgcgtacaagctgggcgcggccgggaacgcgccggacggccgggtggtggtcacctccggtggtggaccgaaataccggcccggcacccgggtccggctgtaccggatctccggccaccgcgacgccggactcaccgaatgcccggggaccagcctgtatcgccggctgccggcgatccgggcgctcgccggtggtgctccggccgggctgcgcttcgccaaactgaccggttcgacccgctggggcggcgcctactggacccgggggtcgctcaccccgctgtggtcgctgagcacccccgggcaactgctcaaccgattcgacgtgtacgtcgacggcgacctcgtcctctcccgggcgtccaccgaacgtctcggtcagcttcagctgagtcccggcccgcacaccgtcacggtcaaggccctgcacctgtccgggcgcagcgccaccgccaccgtcaaggtgatcgccgacgtcgagccgcccgccttcaccacgctgccgcaggcctcgctgagctccgggacgatcgggaccagcaccccggtccgactggactggtcggccgacgacccggccgggatccgcgccgccgcgatcagcggggccagccgggccaccctcgacggggcgatccgcagcctcaccggcaccgcaccggtgggcgccgcgtccagctggacggtggcggtcaccgaccatgccggcaacgaacggacggcgtcgatcagtcgtaccccggcaatcgtcgcggacagcgacgcgacccggaccggaagctggcggacggtatcggacagccatcatctcggtggtgcggcgtccgccgccgccagcgacagcgcggcgttgagctggaccttcaccggccgctccgcggccgtcgtggcggcccgcaacccggcggcgggccggctcaagatctatctcgacggcgatttcctggggtacgtcgatctccgctccgccgcgccgcaataccgccgcctggtctggacccaggcgtggagcaccgcgaacgagcacaccgtgaaggtcgtcccggaagccaccgccgggcgcccgacggtgaccgtggacgggctcgcctatctgcgctgagcgcccgccggggtcagcccgtagtccttcaggacgatcgcgtcggccttggcgaactggctcgccatcaggtcccggatcggccagcgggtcatcatgcccatcgtcttcgcccgggtcttgatccacagggcggacttcggggccatcccggccgcgccacccggcggcagcttcgtgccggtcgccacgtacccggccatctcgctctggtaggcggcgaacgcccgctccggatccccgtgccggctcagctcaccggccagcacgtacgcgcccaccaggctcatgctggtgcccagcccgacgatcggcgacccgcagtaaccggcgtcgccgaccagcccgatccggccccgccaccagcggtccacgtgcacctgattgatcgagtcgaagaagaagtcgggcgcgtccgccatctgcgcgagcaggctcggcaccttccacccggcgccggccatccgctcggtgaccacccgcttctcctcgtcccgggagagccgctcgtagcgcatccgcggctcgcggaaccccaggtgcgccttcgccgtgccgccccgctccgggcgcaggccggcgaccaggccgcccggctcgttgtacatcaggtaccagttgtccatgtcgcccggatcggccaccgtgaaatacgccgagtagaggcccagataccggacgtactcctggtccgggccgaacgccagcgagcgcacccccgaatgcacaccgtcggccccgagcaccaggtcgtagcgttcccgcaggccgctggcgaaggtgacgtccaccccggcggcgtcctgagccagggcggtgatccggtcgccgtaccggtagtcggtgaagcccgcggtgacgtcccgcaggatctgcgccagatcaccccgggcgatctcgatctccgcgacgatcccctcgccgccgaacgcctcggccggcatccggcccatcgaccggttgtgcctatccaccagcttcaagccgcgctcgtcgacctgccgggcccggatcgcctcgcggatgcccatccactcgatcacctgccgggccacgccccggacgtccaccgcgtgcccgcccgggcgcgggccccgcgacttctccaccacggtcacctcggcgcccgcccggtgcagccagaatgcgctggccggccccgccacactgctcccggaaatcagaacccgcatctccccgctcctctgcgtacgatgtactcgatgtactaggaacgctagggtgggctgaggaaaaaggcgaaccgcactagtacggaaaggcaggtgtactaggtggccgaggcggcgtacacacggatcgtggccgaactcagacgccggatcgacagcggtgagctgcgccccggcgaccgggtgccgtccgcgcgagcgatcacccgcgactggggagtcgccatcgcgaccgccacccgggcgcacgctgtactgcgcgacgccggcctgaccgtctcccggcccggggtcggcaccgtggtggccgggccggccccgcgccgcgaccccgacctcagccgggaccggatcgtcgaggtggcgatcgcggtcgccgaccgggacgggatggccgaggcgtcgatgcgccggatcgccaccgaactgggcgtggccaccatgtcgctctaccgccacgtgcccgggcgggaggaactggaactcgccatgatcgacgcggcgctgggcgagctgcgggtgccgccgcgatactccggggactggcgggccgacctggacggctgcgcccgcgccctgtgggagctgttccagcggcacccgtggctcggcctgaccatgtcgctgacccggccgcaggtctccccgaacgcgatgcggctcggcgagtggatcatggggacgctggggcggacccggctcgtcgccaccgaccggatgatggtccaggtgctgctgttcagcttcatccgcggggtggccagcgcgctgcaaccggaagccgaggcgatgcgcgacaccgggctcaccggcgacgagtggatggaggcccaggagaaggagttccagcgcttcgtcgaggcgaacccgatgccggcgtacgaggagctgttcctgcgtacgcccgacttcgtcttcgacctcgacgtgttgttcgagttcggcctggcccgcttcctcgacgggatcgccgtctggatcgggtgagcgtgcccccggcggcgccgggtcgatacggtaagcgggtgtctcagatgccgtggtggggactgcccctcgtcgccgccgtgttcgcgctggccggcgccctggccgtccagttcgccgccgcccggaacaacaatctgctgagccgacggcggcgcacccgccggtggtacgaggaacggaagaccgcctatgtgcagctgctggccggcttcgaacgctcctacgtgcgcctgcgcgccggcttcgacgccggtgagaaaccgccggccctgctgcagtacgtcgacgagatcggcccggcgctgatgccggtccggctgctcgcctccggcccggtccgcagcgccgcgctcgccgtccacctgcagatggaacgcctgcacgggccgatgaacccggccggggtcagcggggtgcggccggagacccacttccgggaactcctcgcccaggtgccgctgatcatgcagcagttcgaggcggcggtccgcgaggagctcgggatcgaggcgagtccaccgaacccgccggcccacaccgccaacggcaaggcccgcctgccgaaacggtgggcgaccctgcgggctgcggactcggtggccacccggccggagcgcgacacccactgacccggccggcgcctccgccgggcccttcgccggctgactcccgacagccgcgggaatgcgctttcctgcagcgcgggaaacctcccgccggctatggcatccggcccctcgcctcgggcaggatcgaaggcgtgaccgatcaccgtgcccccctcgaccccgtctccgcggccatcgtcgacagcggcgtcgtcgccgtcctgcgcgctcccaccgccggcgctttcgcaccggtcgccgacgtcctcgtcgcggccggcatcaccgccctggaggtcaccctcacctcccggggcgccctcgacgccatctccggcctgcgccgccgcctgccgcagggcacggtcatcggcgccggcaccgtcctcaccccggacgacgccaaggccgccatcgacgccggcgccaccttcctggtctccccggtcctggacaccctcaccgaccagccggtcccgtgctacccgggcgcctacacccccaccgaggtctacaccgcccaccgggccggcgccccgatcgtcaaactcttcccggccggcggcctcaaacccggctacctgaaagacctccgcggccccctgcccaacgtccgcatcatgccgaccggcggcatcgacctcgacgacatcgccgactggctcaccgccggcgccgccgccgtcggcctcggcggcccactgatcggcgacgccgccaccggcggcagcctcaccgccctggccgcccgcgccaagcacgccgtcgacgccgtcaccttcgcccggtcatgaccgccgcccccaccccgctgcccgcccccaccccgctgtccgccgtcggcccgctctagctagctaggccagccgccaccccgccgccagccgccaccccgctgcccgccgccggcccgctgcccggttccagcggcggattgttcaccttcggtgaggcgatgggcatcttcgtcgccgacgggatcggcgccttcgagcacgcgcgggcgttcaccctggcggtcggcggcgcggaaaccaacgtcgcggtcggcgtcgcccgcctcggcggcgccgccacctggctcggccgtctcggcccggactcgaccgggtcgctgatcgagggccggttgcgcttcgccggcgtacgcgtcctggccgtccgcgatcccgcccccaccggcctgatggtccgctatcggcgatccgcccagttcatccacgccgactatcaccgcgccggcagcgcgggctcccgcctgaccccggccgacctgccgctgaccgagctgcagcaagccggcatcctgcacatcaccggcatcaccccggccctcggcgacaccgcccgggccaccgtcttcgccgccgtcgaggccgcccgtgccgccggtgtcccggtctgtctggacgtcaactaccgcggcaaactctggtcccggttcgacgccgccccggtcctgcgggacctggtctcccgatccgacatcgtcttcgccggccccgacgaggcggccatcttcctgaacacggacgaccccctggacggtctgaccaagctcggccccaccgaggtcatcgtcaaggacgggccgcacggctgcaccgcactgatcgacggcgaccacttcaccgtccccgccctcccggtcaccgccgtcgacccggtcggcgccggcgacgcgttcgtggccggctatctggccgaccgcctggccggcgccactccggcgcagcgcctcaccaccgccatcaccgccggcgccttcgcggtcacggtccccggcgactgcgacagcgcgcccacccgcgccgacctcaccgccctctccggcgccgacatccaccgctgagccgatcccccgtaccgccgcaatcgcctctcaagccccgcggaccgcccccggcgccgcgaccccaaccagcacggacgccgcctggtgggcggtccggagcggtgcgtgtggtgcggggcggttgtcaccgtgctcagcgcggacgccgcctggtgggtggtgcgggtggtgcgcggcggctgtcaccgtgcccggcgcggacaccgcctggcgagcggtccggagtggtgcgggtagtgcggggcggttgtcaccgtgcccggcgcggacgccgcctggcaagccgccccggggagccgcaaaccggcgcggaaaccgcccaccccctgctcatggtgccgatgtgccacatgtgattgaccgtattccgaccgggtaggcaataggcagcggcaatttcatcgatttcgaggaggccgtcatgcaacccaccccgttcaccccgtggtcgttccgggatcccgaggcgctgtccggtggctaccagccgaccgaggccgacgtcgtcgacgagaccggccggatcggcgtggacctggtcggttaccaggtcgaggcgaccgatgggcacatcggttcggtcgaccaggccagttacgacgtcggcggcgccttcctggtggtggacaccgggccgtggatcttcggccggaaggtgctgctgccggcgggtacggtgcagaacgtcgaccaggcggaccgcaaggtctatgtggaccggacgaaggatcagatcaaggcgtccccggagtacgacaaggacaccttcgagacgtccgcgtaccgggaccaggtcggtgactactacaccggcagctatcgcgattatccgcgctgatcgcggatgacgaccgccgcccggctctccacggacagcagttcggcgagccgggcggcggccgtcagcatcgcccggccgcgatcggtgagccgagcccgccagtcgctgagcgatgccgccagggacgccgccccgcccgcgtcgcgcacctggcgcaggacggtcgcgatgtgcggcagcccgtatccgccgcgccgcagcaggtgggccaggtcggcgtcgcgcacgtcgtccggcgagtacgcccgctgcccccggtcccggaccggcacgagaatccccgcctcctcccatttccgcagcgtcgccggggtcaccccgagccggtgcgcgagcgcgccgaccggcagcgccgccccgcgtcgggtgggcaccgtcagcacctcggcggttgcctcgaccgccgtcagcgtctcccggtcccgggcgagttcggcatgcccggcgtcgatcgtggcgtacgcggtctccaggtcgccggccagcaccgcccgcatgatcaccccggcggggccgtgcccgtacgccttggccagtgcgaggaacgcggtcaccgcgagcaggtgccgttcctcgtacgcccggtagccgctcgcggtccggcgggccggcgggatcaccccgtcctgctcgtagttgcggatcgcctgagcggacagcccgtgtggccgcgccaggtccaccggtcgcagtgcccgcctttgagactttgccatgcagctcctgccactccgcggagaaatcctcacagggtgtctcaacgatacggtagaggtcatggagcttgacgaactcgccgcgcgcatctgccggcttcccgaggtggtccagctgatcgccgggcccggcaccggcgccccggagctgagctggggtgaccggttcttcttcgtaggggaggaccggatgcgcccgttcgccacgatcgtcgtccgggacgtgcccggcttcgacgagtgttccggcctggaccggccgggcgtcttccggctgaacctggagctgggccggtcccgtttcggcgacctgttcggtttcggcccggaggagttcgcggcgcgccggtccgggatcgacttcgccaccccggaccgctggttcccgcatccggtgtacgcggtgcagagctgggcctcggtggtcaacccggtgaccgtcgacgtggactccctgatcgggcacgcccgcggccggcggcgctgaccggatcgttccgcctccggcccggatggtgtctgccgccgcggcgtcggtccgggtgggatggaggcatgaccgaagccttgatcgtcatcgacgtgcaggagtcgttccgggcccgcccgctctgggcggccgtcgacaacccggatctgatcccgaacgtgcagcgcctggtcgaccgggcccgggccgccgggcacctcgtcgtctgggtgctgcacgccgagccgggcaccggtggcgtcttcgacccggcgagcggtttcgtccggctgatggccgagctgaccccggcggacggcgagccgatcctggtcaagaccgtgcacaacgcgttcaccacgacggacctgcagttccggctgaccagcgccggcgtccgcgcggtgacggtctgcgggctgcgcaccgagcagtgtgtggagacgaccgcccgggtcgcctcggatctgggctatcaggtcacgttcgtcaccgacgccaccgccaccttcccgatcccgcaccgggacgcccccgacgacctggacgacccgcgtacgctgtccgccgcggatgtggtggcccgcaccgagtacgcgctcgccggccggttcgccacgatcacgaccgtcgacgaggtcgagaaggggtgaccggattgtgagcctggtggtcttcgtgctcaccccgcaggtccacctgctcgacctggccggcccggcccaggtgttctccaccgctccggactacacgctgcactacgtcgccgacgccgacaccgtccccacctggcagggcgtcaccctgcaggcgtcccgggactggcccggcctcaccccggacgatctggtcctcgttcccggctggcgcgacgggtacggctacttccgaccggagacgctgcggcggctccgtgagcatcacgaccggggcggcacggtcgccagtgtctgcgccggggcggaagcgctgggccgggccggcctgctcgacggccgccgctgcaccacccaccacgatctgcaggacacgctggcccgcggctatcctcgggccggcgtggtccgtgacgtgctgtacgtctccgacgaccgggtggtcacctcggccggcatcgccagcggcatcgacctggcgctgcacctggtggcgctccggcacggcccggcggtcgccgcccgggtggcccgggagatggtcgtgtacgcccggcgcaacggggacgagtcgcaggccagcgcgatgctccggcatcgcgcgcacctcagcgacgtggtgcaccgggtgcaggatcggatcgacgcggcgttcgccgagccactgcggctggcgcagctcgccgccgcggcgggggtcagtgagcgtacgctcagccggctcttctcggcggcgacgggccgcacgccgctgcgctaccagcagttgctgcggatggagcgcgccgaatatctgatcggccacggcgcgaccgtggaggccgccgcccgggcggtgggtttcggcgacgcgcggatgctgcgcagactacgtgcccggaaatgacacccgcccggtccggacctggccgaaagtcggggatgaccagggctgaaccgggcgggcggcgggggacggtcagcgatgggcgggcagtatcggcggggatgccgacgatcgtgcacctgtaaccgctttctgtcaatgccggaaaacaattaacaaagcgtcccggaataccattcttttattgctgtcgtacgagtcggtgtccgcccgtcccgacgaaggtcgcccgccgcgcccggtcttttccgcggaccaccgagcggtcagagcagaccgcgtaccgccgcgatcggaagtgccgtgcgggcgtgatacgccgaacgccacagcccgccgtgcgccgccgccaccgtctcgtcgcgccaggccgccgcgtcggcggcgcgcggccggcggatctgatggatcatcaggatcgccatcagctcgctcgccgtggccgcgtcgaagacctcgacaccgaacagatgggcgcccgcgtacgccgccttgagcagccggttgctcagcaccgaccgggtgcgcgccggcggcgccaccgcgaagctgaccaccccgtcccgtcggcccagcgtcgcccgccaccggtggatccgcttggccagcgcatagttcggcccctgctgcggcaccagactgtcgttgatccccggcgtcgacggcagcggatagttcggccgcagcagccgcccgccggacagcggctcgaccgcccgggcccgcacgccccgcccggcataccgctcccgggcctgctcgaccgcgccggccggcaccgcgtagacatcggtcggggtggcgagcaccgcgaacgcggtgtccggccggcgctgccgcagatgcacggcgagcgcgtcggtcacggccgccagcttcgggtaggcgctgcccggcgcgtacccgtagttacccagcaccagcggccggtcgaaactcagcagccacgccgcgaccgcccccggatcggcggtcaggtcggcgcccggcgtgccggccccgcggaccggggcgaacagccggcccgccgaacccgccgccagcccggcgatccgctcccacagatccggccggggcaggtcgacggcgagcacggtggcgccccggtccagcagccaccgcagcggacccatctcggcgcccgccccgagcagcgcgaaagtgagatcgctcagatcccgccagtccgggtcggcggccacctcgcgcaccgcgtccgcgcacgacggctcgatcaccccggcggcccgccaggcatcgaggcggggcagcaggccgacggtgcggtccggcgcggccgagccggtcacctcgaccgtccggtacggctcgccgccgcccgccagcaacgcctgggccagggtgaactcgccgtccggtcgtacgtaccggatccgggcgtgcaacgacaacaggccggcctcggcgatctcgtaaccggccgcgccgtccgcgctcaacccggcctccaccagtgcccggaagtgccgcggatagccgcgccgccagtcggcctcccgctcggcggccccggccgcggccgggtcgacgacccgcagggcgtcggcgaccaccgcgcggcccagcgccgtgccactgcggcggccggtctcgtcggccgggaaatcaacatggggctgcaccgcgccagtatgtccttctcctaccaggggtggacgtcacctccgacgaatggccgcggatccggccggcggaggggcgctttcccccgcgggccagccgagtctgtcgatatgacaaccgtcgcagtcgccgcgccgccgcgccggcaccgtccgctgaccgtgctcacctgggcgtcgctggccctcgcggtgatcgccgggatcggcctgatcgccgacgcccgcatcctgaccggggtgccgatctggctcaagccgttcaagttcgccgtctcgttcgccctgtacgcctggacgctggcctggctgatctcggtgctgccccggcgcagccgcgtcgccgaaggggccgccacgatcatcggcgccgcctcggtgatcgagctggccgtcatcacggtgcaggtgatccggggcacgaccagccactacaaccagagcaccccgctgaactcggcgctctggtcggccatggggatgtcgatcatggtgctgttcgtggcgcacctgacgatcggggtggtggcactgcgccagcgggtcgcggaccgggccaccgcgtacgccatccgtctcggcctgctgatctccctgatcggcatgctggcggcgttcccgatgaccacccggaagaccgcgtccgggctggtcggcgcgcacagcgtcggcgtgcccgacggcgggcccggcctgccgctcaccggctggagcacggtcggcggggatctgcggatcggtcacttcgtcggcctgcacgcgctgcaggtgctgccgttgctggcgtacgcgctgggccgctgggcgggggaccggttcgacgcgacgacccgggcgcggctggtgctggtggcgggcaccggatacggcgtcctggggccgctgctcacctggcaggcgatgcgcgcggaaccgctgctgcggccctcagcggtcaccctcgccgcgttcctcgtcgtggccgtcgcgaccgcggccggcctgaccgccgtcgcgtcctcctccggcaggatgcgcgcatgaccggcgccctgttcaccctcaccttcctgctcgccgccccgttctgggcgctgatgatcctgctgcccggctggaccggcacccggcggatcatcgggtcgccgctgatcgtgctgccgatcatcggaatctacgccgtcctgatcgtcccgaacctgggccacgtgctgcccgcggtcgccaaccccaccctcggcggcatccgcgacctgctcggcagcgcggacggcgcggcggccggctgggcccacatgatcgccttcgacctgttcgccggccggtggatctggctcgacgcccgcgaccgcggcatgcgccacctgatcctggccccgatcctgctgctcacgatcctgttcggaccgctgggtctgggcacccatctcgtcgtccgcaagtcctaggctgtggccatggctctcgacgcgcgggacaccctgacccgcatgctgctgctcgactgcagcggcctggcctacctgctcgtcatcggccgcaccggccacccgcccacccccctgcagtgggcgctggccgtgcccgccttcctgtccgccctcctgctgcaccgccaccccccgatcaacctgctcctgcagaccgcgctgttcgccgccgggatgctgctgctcgacgactccaccatcaaccaggtcggcacggcctgggcgatcggcgagttcgccctctgggccggcaaccggtggctgctggccggcggcatcggcatggtcgccgccacgtacctgatctgtgacccgcccgacgccgtcctgccctcggtgatgggcctggccaccagtctcggcctgcccaccctgatcggcctggtcgtgcgcaccacccgcgagctcggcgtgcaggccgagcaacgcgccgtctccgagcagcgggccgcccgcgccgacgaacgcggcgccatcgcccgcgaactgcacgacgtggtggcacaccacgtcgcgtcgatggtgctgcgcgtcggcgtcgcccagcacgtgctgcccggcgtcgacccgaaagtcgccgaggtcttcgacgacgtccaccgcaccggcacggccgcgctcggtgacctgcgccggctggtcgccgtcctgcgcgaccccgaccgcgcgcagggcgacgccgcactgaccgcgatcgagccgtcggcgctgccggccgccctcgacggcgcggtggagacagcgcggcgggccggggtcatcgtggaagcggagatcgacccgcgggtggccgggctcgacgcggtccgcgggctggcactgctgcggctcacccaggaggcgctgaccaacgtggcgaaacacgccgggccggcggcgcgggccgtcctgcgggtcacgatgggcggcgacgacctgcactggtcggtcaccgacgacgggggagcagcgcccggggcggcgcgggttcccgggggtgggcacggtctgaccgggatgcgggaacgcgtggagattctcggcggggccctggccgccgggccggagggctcgggttggcgggtctcgaccgtccttcccgcgccgctcccggacgggatcccggcatgatcggtcgcggtgttcgtcccgcgggtcgtcgttcagcgggcttccgcatgatcggtccggtgctcgttcagggggcttccacgtgatccgcgttctgctggtcgatgatcagcaactcatccgggccggtctgcggatgctcctcgacgccgaacccggcatggaggtgatcggcgaagccggcgacggccgcaccgcgatcgccctcgccgcccagctcgtccccgacgtgatcgtcatggacctgcgcatgcccggcgtcgacggcatcaccgccaccagccgcatcatggccgaccgccctgccatccggatcctcgtcctcaccaccttcggcgacgacgaccacctctacccggctttgcaggcgggcgcctgcggtttcctgctcaaggacgccccgcccaccgacctgctgaacggaatccgccaggccgccgccggtgaaagcccgttctcccaggaggtcctccgccgcctggtgcgccgagccgtccacgcccgccccgaacccccggcgcgcatcgacggtctcaccacgcgcgagcaggaggtactggacctggtcgcggagggcctcaccaacacggagatcgccgaacgcctgcacatcggggtgaccacggtcaaaacccacatcaccgcgctgatgaccaaaaccagcagcccgaaccgggttcgcctcgcgctcgtcgcccgccgccgctgaatccgcggtctgccgagggcggcttgctgtcggcgcggtcggtccatccggatccgctggccactttcggtcgtcgcgctttccggtgaaaacatgggggtacgacctgtgcggagccccgccgagcagcgcgatgatccggcccgctccggaccgtccggcgcgtatcccgggtgtacgcgggtggttgcggtggtccgccccttcgctgtggtccagcgccgccgcaacgttccgggttgctgtcctcccttggcgttcaccgaccgctgcgatgatccatccgctggcgcccggtgaccgccgcgtgtcggtcgcgacgcccgggtttcgcggggctcgtcctccgaccgggtggtgtgatcggggtcgcgcccaccccggtttggagttgcggggcagggcctgtaatgttttccgagccgccagggagacgggcgagcgaacgagacccgcgaggggctcgggccggccgtcctgacggaaatcctccaacgatctcgcgatccagtgttgcgggttgctggatgggtgctgctcaccatttctggtgcgttgaaatccggttgcaaaacacggatttgacgaactgagaatggcgggtaaagtagagctagctagctagccgcggatcgatgcgaatcggtccgacccgggtgtcaggttgctggtttggttccgcgctgacaagtgtttcggtggtcatagcggaggggaaacgcccggttacattccgaacccggtagctaagccctccagcgccgatggtactgcactcgggagggtgtgggagagtaggacgccgccggactcaacttcgagaaacgcccacccgggaacgggtgggcgtttctttttgtctcggtcagctcggccgggccggcgtgacggcggtcagcgggggagctggtgcaggatgctggggtcggtgatcctgtcgtcggcggcgaggaggaaagccttggagaggatgaccgagaggcgttcgtcgtcgtcgaagggcagggcgagccgggggtggcggccggtgggaacgatgcagaggtaggcgtcgttcggttccatcaggatgttggccgaacccaggtggattttgtaggtggtccgggtgccgtggacccgcaggaagcggtcgtcgatgtcacaccgagcggcaatcgtgaggcggggaagcaggcgggccaggacgtcccggcggacctcggcgctgccgctcagggtgccgaagccgatttcccgccagtaggcgcggaacgggtgctcgccccggtcggtccagctgtcgtcggtggcgatcgacgtgacgccgatgaacaggtccacgtcgcgcagcgcctcgctcaagacccggggtgggacctcgtcgacgcgggcgggctcccaacggtgcccctcccggcgggcgaagcggacctggtcggtggagcagaactcgacctcgtcacggtggccgagcgggccggcggactcgtgggcgaaggaggcctcccactcaccggccgcgaactccttggtcgccgcactgtccgcaccgctggaccaggtgcccagataggtggctgaccagccgcggacccgcatcagcgcgttcgcctggcggtagcgcaggatgtgaccggcgaaccggttcgagtaggtgccggtctgcgtctccgccggggtcaaccggtacacctcgcggaaggcctgcttgaacggctgccgcaactcggcggtggtgattcggtcgcgccaggcggtcacctcggccggatcggcgaggaccgggtgccacaggcgcaccgaacacccggcgccggagtgcccggcgagccgccagccgccggcgccgtccggctcgggcagggccgccgtccaggaggtgccgccggcggtggacacctcccagatcaggcggcggccgagggtgccggtcaccgggtggcggaggtagcgctgctcccacgccggccagtcccaggtgcggtcctgggcgagcagcgcctccacccgggcgcgctcggcggccagcgtcttgttgacctccgcggccagcgttcgcgccggacccgcctgcaggcgcagcgccgccggaacaccgcgcagcggcaggccgtcctgccaggcgcggaccgtcgccttctccccgatgatctcgacgccgagggtgaagtcgtcgccggcggcatatcggtgggtgctgtccggggccaggtcgtggtcggcgacggcgagctccatggcctcgccgggcgcccagccgcgggcggccgcgatgcgctccagagccgtccacacccggtcgcgcagggggcggctgcgggtgttcatcagccggcccagcacgcccgccggcgcctggccgggccggtcggtaaggatctcgaccgtggcggcggcggtcatcgcggccgtcaaccgtgcgccgccctgccgccagggtgtcgccgccgttgccgcgacgcgtcccaggagcgtggtcgactcctcgccgggatccagggacagcagccagctcaagccccgcagcaggaggtcatggtcgtcgtgcacgggccggcccagctcgacgaaggcggcgagcacggtgccgatcgacgcgggaacctccgggccggcggcgcgcacccgctccgcctgccgcagccagctcttcgccgggaccggcttggtgagcgtgatcgcgaaggccagcgcgtccctcgtcgcggggtcggtcacccgggcgccgagccggtggcgggccagcgggccgaatccgtcctctccgaacagcaggtgggcggggagtccgccggtgagccggccgatggcggtcccgtactgcgcgctgatcgagcggcgggcctcggtgggcatggtccagtcggacagcacctcgtcgaggaccgcgccgagcaccggaccgtacgcccggagctggtcgaccggcagctggttggcgatgaccgcgggcaggcggtaggcctggccgtcgtaggggacccgggccgtgccgaggacccgcagcgcccaggacaggtcctcgcggcgccagggcagcggctcggcggtcagctcgtagaggtcggcgccggtgccgtagtcggggctgccgcgttcggccgccgcgaggtgccactgcagggcgaacgcccaccgccgcgaatccggcgcgggctccgcgtccaccgccgccggaatcaactcaagccacttgtccatggccgggatcatgccgggccggtacgacaagaatttctgtcgtacctcgcggccatgatggcgggcggaagggagaagccatggccgaggtgctgatgcgggacgagacgatgaccgggcgggagatcgggtcctggatgctgccggatctgccggatcggatccccgcgcgggagttgctgcggttacgggtccgtgaggaggtggcccggttcaacgccgccggtggtgagctgtatcggggcctggtgcgaccggccgcggcgaccgagacgccgcacggcttccggatgccggccggcgggcggatcgacgagacggcccaggccgacgcggcatgtgcggcgttcgagcggaacgggttcgtgatgatcgccggggagcggcaggtggagagtctcgaccagatcatcgacctgcgccgggatgccgaggtggcgttcatccgcttggtcgcgctggtgggtggctagagcgcggtggtccggctggacgccggttcccgcgcagtgcccccgaagtgcggcggggtggctcacgacgtacggccgaaagggtgttgatgttgatcgtctcggtggcaggttggttcagggggtgtgcgggctcaagcgggggcggtggcggccgatcacgcggggcatgcgtaagtggaccctcggcgcccttctcacctcagcggtcgccgcctcggctgccctgctcggccctgccccggcgctggccgcagggaccgtgatcggcgcggagctgcccggtgcgctgccggggcggtacatcgtgaccctgaaggatcgggggaccgggccgagcgtgcacagcatgggcgccgggaggctggtgcgcagcttccgctcgattcccgggttcgcggcggagatgaccgcggcgcaggcgcggcggctggcggcggacccggcggtgcggtcggtcgagcaggaccgcatgatccacatcgcgacgcagaacaggccggggtggggtctggaccggatcgaccagcggagcgcgacactgtcgaagacgtacacggcgaccgatgacgggtcggcggtgcacgcgtacgtgatcgacaccgggatccggatcacacacagcgagttcggcggccgggcgtcgtacggctacgacttcgccgacggtgaccgcgtcgcgagcgactgcaacgggcacggtacgcatgtggccggcacgatcggcggcgcccgctacggggtggcgaagaaggtgcagctggtggcggtgcgggtactcggctgcgacggcggcggcagcatctccgacgtgatcgacggggtggactgggtgaccgagcacgcgatcaagccggccgtggcgaacatgagcatgggcggctcggtcagccggtcgctggactacgcggtgcaggagtcgatcgcgtccggggtgacctacgtggtggcggccggcaacgaggacgacgacgcccggtggagcagcccggcggacgtgccggcggcgatcaccgtgggagcgaccgacagccgggaccggcgcgcgtcgttctccaactacggcagcggggtggacctcttcgcgcccggcgtcgacatcaggtcgtcggtggcggacagcaacaccgcgaccgacgtctacagtggtacgtcgatggccgccccgcacgtcgccggcgccgccgccctgctgctggacgccaacccgagcctgacccccgggcaggtgcgggaccgcctggtggccaatgccaccaccggccgggtcgccgaccggatgggctcgccgaaccggctgctgttcgtgaccgcgcccccggcgaaaccggtgatcgcgacgacccgcacggccgccgcggtggtcggcaccgagttgtccacccggctggcgctcaccgcgaaccgggtcggatcgtggacgctggccggtgggacgctgccgccggggctgtcgctgaaccggtccggggtgctgtccgggaccccggcgcaggcgggcgactacgtggtgaccgtgcggttcaccgactacgtgccgcaggtggtcacccggcaggtgacgatcccggtggaggcgagcgtgccggtgatcgacccgacgctgcccgacgggcaggccggtgtctattacgagggtcagctgaccaccgcggaccagcgggacggcgtctgggcggtgaccgccggggcgctcccggccggccttaccctggacgaggcgtccggcttgatcagtggggtgccgtcggcgaccggcagcttcaccgtgcggttcaccgacccgtggggtcagacggcgaccgcggacttcacgatcacggtcggcgcggcgtgagcatgcggcgcttgcgctgagtatgtggcgctggcgctggcgctgagcgtgtggcgctggcggtggagcgtgtggcgcttcgtggtgaccgtgtggcgctggcggtgagcgtgtggcgctggcggtggagcgtgcggcgcttcgtggtgagcgtgtggcgctggcggtgagcgattggcgggccccggtgagcggtcccggagcccgtccggctcaccagtccgcggccgccgcgtacttctgcgcgatggccgccgtctccggcaggtcggcctcgaccaccggcagcccggcccggacatccgcgcccagctcgccgagcagctggcgcagcagcgcctcggccgccgcggcctgcggcgcgatcccggcggtcaccaccggcaccgcgtgtttgccggccagcgcctggttgggcagctggtcgaggagcaccttgagcactccggtgtagcttcccttgtacgtcggtgtcgccaccaccagcaggtcagccccggtcagggcggcgaccgcggcggccgtgccggagtcgcccggggtgagcagtccggcgcccagcgtgccgacctcgatcaccgtgggcgcgggcgcgccgtgccgtgtggccagcgcctcacccaccgcgatggccagggccgatgtgcgggagccggctcgcggattgccggaaaccacaacgattgccgtcatcgccattcctctttcgacgcgtccactggttgagaaccagtcgtacgctcccacccttgtggccggcccgacatcggtcaaccgtatcccaaatcctagtaataccgtgggtcggatgggttttaggactggtgtgatgtggcgctcgcgactaccatccggtatgcctatctaacagataggaatagtatccttgcagggtgccgccggatccggtggcaggagccgttgaaggagtcgcacatgtccgcgctcgccatcgcccatccgcgcgccagccatatccgccccgatctgcgtccggtcccggacctgccggagcaggctccggtcaccgtcaccatcagcatcgccggcggcgtcggcggccgtgaccgggtgctggccgcgctccgcgaactggttgacgccgccgggccggacgccgcgatcgagctcgacgagccggtcgagtcgcccgccgacggtgagatcgtgctggacccgcgggcgcgcaccgcgctgcgcgacggccgccgcctcgacctgagtcgcctggagtacgacctgttgctcttcctggcccagcacccgcgtcaggtgttcagccgcacccagctgctgacccacgtctggggtcatcggcacaccaccaaccgcacggtcgacgtgcacgtcagccggctgcgcaccaagctggacgatccggagctgatcaccactgtctacggcctcggataccggctggccgacgacgcgccgattgccgtgctggagcactgatacatcccgaaagggtcataacgcggcaatatggtgagctaattttcgcaggtcagcaataacttgatcactattgtgacagattgacccagccttgcaacaacatcgataaatttaaatactgtggagcacctacctacccaatccccctgggaggaaccgtgctcaacccgaagcttcgccggccgatcgtcggcttggcggccggcatcctcatgggcagcgccctggtcgccgcgtcacccgcctcggcagccccggccctggccgacccgtccttcgcgccgtccgccctggccggccggatcgacgcccagctgggcacccgcgacgccgggtcctacctggacgcctccggcaagctggtggtcaacgtcaccgacgcggcgaccgcggccgacgtcaccaaggccggcgccaccccgcgctacgtcgcccgcagcggcgccaccctggccgccgccgacgccagcctcaaggtcaacctcaagaccccgggcaccgcgttcgccgtcgacccggtcagcaaccaggtcgtggtcagcgtcgacgagagcgtcaccggcgccaaactggccgccgtcaaggcgaccgtcgccaaactgggcgacgccgcccggctcgaaaccatcgccggcaggaccagcacccggatttccggcggcgacgccatctacaccagcagcgcccgctgctcgctcggcttcaacgtccgcgacagcgccggcacatactacttcctcaccgccggccactgcaccaacatcggcgcaacctggacgaacggctccagcacgctcggcacccgggccggcaccagcttccccggcaacgacttcggcatcgtccgctacaccaacacgtcggtcaccaagagtggcgccgtcggctcccaggacatcacctccgccggcacccccgcggtcggcgccaccgtctaccgccgcggctccaccaccggcatccactccggccgggtcaccgccctcaacagcaccgtcaactactcggaaggcaccgtctccggcctgatccgcaccaccgtctgcgccgaacccggcgacagcggcggctccctgtactccggcaccacggccctcggcctcacctccggcggcagcggaaactgcacctcgggcggcgtcacctacttccagccggtcgtcgagcccctcagcgtctacggcgtctcggtctactgaccgacccgcggccccagcctccgggcttccgggcctccgggcctccgggcctccgggcctccgagcctccgggccaaacggtttcaccttcgagatgccggccttcgctcaggaggccggcccctcgcggccttcgcgcgtcgcccggcgggaagtaagactgatcccaagtccgactctccgacgcagggccgggcggcacgcaaggtcccggcggcggggtcgcggtcagcgatcccgccgctgccctttgccggcgttcaccatcggcgctgcccatcgcgagcccagccgaggcgagccggactgaggccggcccagccgagctggaccgagccgaatgaagcccgaccgagcccagccgagcccagctggaccgagtcggattgagtcgggctgaaccgaactgagccccgccgagtccagttggaccgagtcggattgagtcgggctgaaccgaactgagccccgccgagtccagctggatcgagccggattgagtcgggctgaaccgggctgggtgctggtgggtcagggtttgacgtggtggtcctcggtgcgttcctcgccgcggcggcggaggagtttcaggccggggaggccggcgatggccaggtgcaggtcctcggtgacctcgaggagtttgtgcaggtcggggccgacctggtcgagcttgctgagcagcggcatgacgtcgttgaccatgtggtcgcgcagggcggggagttcgtcgaccatccggatggcggcggtgacctcctccggggtgagctcgtcgatgaagcgggcggcgagcggtgccgctttgcgcagggtgggggcgtagtcgtcgaggagctcggtggcgtcggtggcggcctggccggcgcggtcgacgacggcggcggcgcgggccgcgacggctcccgcgtcgctagctagctagggcggcggcgctgaccgcgccggcctcggcgacgatctcggcggctgaggtcgtcaaagtgccggcttcgatgatgatggtgccggcggcgtcggcggtggcacccgcccggtggacgatgtcgccggccgccgaggagatcgcaccgacctcgtcgagggcgaggctcgccgcggtggtgatggcccggacctcgccgaccgcggtctgcgccgccgtggtgatcgcctggatctcgccgaccgcggtgtgcgccgtggtggtgatggcctggatctcgccgaccgcggtctgcgccgccgcggtgatcgcctggacctcggcgatggcggtgcgggcggccgtggtgatgtcgcggacgtcggcgaccgtggtctcggccgaggtggtcaccgtggcgacgcggtgcaggaggtcttcggtccgggcgacggccaggccggcccgggtgaccaggagctctgcctggccgaggaggccggcggcgcggaccgggaggctggcgacggcgcccgcggtggagatgacctggccgatcgcggcccgggtgaggtcggcggcgaccgcgggggcgctgagcgcgacgcgggacaggtggacagctcgggacagcagggacgccatgggtccattctgcgcccggccggcaccgcgcgccggtgacggaacgtggtggtgctgcggctcaccgtcgaaattcggatatctgtggacgattcatagtcggcagcacacccataatcggtgtgggcagtgcatcatggctggcgtgcgacgtaccccccattggattctgatctttgccgccgtggtcgccgtcggaggtgtggccgtgctggccaagggtgtgatgggcagcggggacaccggcgcgacgtatctgaccgggagtagcaccggcaccgccgccgggaccggcgccggcagcagtgcgggtgcgtcgccggccgggccgagcgccgccgagctggccaggatcgcacgggacaagcaggtcaaggcgctggacgcggcgctgaggaagtatgccgcgaccgtcccggagttctccgtcgccgtgctcgacaagaagaccggtcagctgtacgcgttccgcggcgacaagagctacgagaccgccagcgtcgtcaaggtgcaggtgctctcctgcctgctgctgaccgcgcaggacggcgggcggcagctgaccgcctgggaggactcccgggcgaagaagatgatcaggctcagcgacaacaactccaccaccgacctgttcgggcatctcggaaggcaggccggggtgcagcggtgcgacaagcggatggggctgacccagaccaccgtgaactccagctggggcctgacccggaccacggtgacggatcaggtgaagctgctgtcccagctggtcgccgacaagagtccgctgagcgcgaagtcccgggcgtacgcgcacaccctgatgagcacggtggacaagggccagcagtggggagtgccggcggcagcgcgctccggtgagcagttcaccgtgaagaacggctggctggaccgttccaccgagcacggactgtggatcgtcaactcggtgggccggatcaccggcggggacaccgacgtctcgatcgcgatcctgtcgcacgggcacaggacgcaggcggccggcgaggtggtgatcgagaaggcgatcaagatgacccggacgtatttgaagtactagacgtccgcctgttccaccaggtgatcgcctggttgatgacgaggatcaggacgatcgcggcgagcacgccctgccacggccgggggaacaccgagccgccggccacgccgatcgcggcgtagacgaccgaccacagcgcgcaggccggcaggttggcgatcacgaaggtgcgccaggacagacccgcgaaagcggccgcgagcagcaccggcacccggccgcccgggatcagccgggagaccagcaggaccgggacctggcggtcccgcagccggtccttgaccgcggccagatgctcctcgtcgcgcagccagcgcagccgccgggccagttgctcgccgccgaaccggcacatcgcgtacatggcgaggtcgccgacgtaggccccggcggcgccggcggccagcacgaacaccatggtgatcgggtggtgctcgtggaaggcgagggtggcggcgccgctgaccgcggcgccggtcggcacgatcgggatgatcgcaccgaagcagaccacagcgaacagccagccgagcgccccgagagtggcgatcacgcggccggtccgacggtgagcgtctcgccgtgggccagcacccgcacccgggtgtccgggcaggcgcgcgccgcgaactcggcgaaccgggtgccgggctcgtcgaacatgtgccggcggatccggcccatcccgatcggccacagcgtgccgtagtgcaccggcaccgcccacgacgccttgacccggcgcagcgcctcggcgccgtcccgggcgtccaggtggccctccgcgcccaggctggggccccagccgccgaccgggatcagcgccaggtcgagcgggccgaggtcgtgcatctggtcgaacaggccggtgtcgcccgcgtaccacgaccgcgaagcgccctcgaccacgaagccgacggccgcggcccgctcccgggaccacgggccgcgcccgccgtcgtgccgcgccgcaacggcgcggacgcggaccgcgccgatcgtgacctcgtcgccgggggccagctccacgcagcgcgccgcgacgcccgggcccagcgtccgtgcggtgaacgccgccgcgccggccggcaccaccagcagcggctcaccgccgacggccttgagcgagggcacgtggaagtggtcggcgtgcaggtgggagagcaggatcgcgtccggcacgccggccaggacgggcgccgggccggccatccgccgcaggtgggcgagccggccggtgagcaccgggtcggtgagcagggtgaccccggagtcggcgagccacaccgtgctgtgcccccaccaggtgaccgatgtcgtgctcaccggcccacggtacccagccgccgggccgcccgtccgcctagctagctaggggcggtggccgtccggcggcgggccgtggcgggtcgggccgaccggggcgtacgtcagtgggctcaccggtgaaagtgtgcccttcccgggacgggatgagtcctgagtcgcagctgtgacgttgctccggcaatatggggccgtgacaggaccccgctcggccgttgtggtgaaccccgccaaggtgaccgatcttgatcaactgcggcagacgctgcgcaccaccctcgccaaggccggctggccggagcccgcgtggttcgagaccacccccgaggaccccggccgcggccaggcgaagcgggccgtcgccgagggcgccgagctggtcttcgcgtgcggcggcgacggcacggtgaccgccgtggtgaccgcgctgaccggcaccgacgtggcgctcgccgtgctgccggccggcaccggcaacctgctcgccgccaacctgggcctgggcaccgacccggcgaccgggctgcaggtggcgctggagggcggccgtcgccggatcgacgtcggggtgatcggcgaccagtgcttcgtggtgatggccgggatgggcttcgacgcgatgatgctgcaggacacctcggagaaggcgaagaagcacatcggctggccggcctacctggtcggggcggccaagcacctgctggaccggccgatgcgggtgcggatccggctggacggcggcgcgccgatgccgcgccggccgcgcaccgtgatcgtcggcaacgtcggtcggctccagggcggggtgcggctgctcaagcgcgcggcgccggacgacgggcagctcgacgtcgcgatcatcagccccaacaacctgttccactggttgcagctggccgccggcgtggccagccggcgggagcgggtgccgctgatggagacgttcaccgcgagccgggtggagatctacagcaaccgggcccagccccggcagctcgacggggatctgatcgcccccggcaaggccatgaagatctccgtacgccatcgggctctgctgctctgtgtgccgcaacccgacgcggacccggacctggcctatgacgcggaggcgaccgcgaaacgggcgaagtcgttgtgagcagcaccgagccggttccggagacccggaccatggccggtgacgagctgtcggccgaggacgcgttcctggccctgcgcaactacggcggctggccgctgctgcgcgacgcgttcatccggttccggtacggcgacggcttcagtcactcccgcgccttcgcgctgcaactgtgcctggccatcgtcccgttcctgatcgccctctccggcctcgccaccgacctcggcgcgaggtccggcggccaggtggtcgccgacacggtgatcgcgctgaccccgggtgccagcgagccgctggtgcgggagctgctggccgacgacaagcgcaccgagcacgccggcgagctggccctgctgctgggtctgatcaccggcctggtcgcgctgaccaccgcgatggcacaggtggagcggggcgccaaccggatctacggggtggagcgggaccggccggccctgcagaagtacacccgggccacggtgctcgcgctggtcgccggcctgcccgcgctcttcggcttcctgctgctggtggccgggcacgcggccggcgaatcggccgagcgacatttccatttcggcgggtggatccacttcggctgggaggtggcgcgctggccggtgagtctggcgctgatcgtctgcgcggtcggcgcgctgttccggcactcgccacgccgccagcagccggccctgtcctggctgctgttcggcgcggtggtggcgaccgtcctgtggtgggcggcgagcctgtccctggccgggtacatccggatcagcggcagcttcggcgccacctacggcccgctgaccgcgatgatggcgctgctgctctgggccaacctgaccggcatcgcgttcttcgtcggcctggccttcgccgcccagctcgaagcccgccgggtcggggcgaaaccggcccagcccgaccagtgggagcctgccggagttcccgcccagcgcaccgacggtgtaccgagcgagccgacggggtaagcacgcgtgccgtgtccgatgtgaaagcgcggcgcttcgccgaacgcagtgtgctgggcctgatcgcggtgatcgtggtcgggctcgggttcgcctcgttgctgctcctggtgcggttccactggaccccgctgcagagcctcgaccacgcggtggcggacgggctcaaccaccaggtggccggctccgacgtcacggtgaaaatcctgcagcagatctcctcgttcggcggccgggtcttcatgatctcgctggtcaccgtcgtggtggtgatgctgctgatccggcgccagcggcggctcgcgctgtacctggtggtcaccggggcgggcgcgctgatcctggacccgtcgctgaagacgctggtcgggcgggtgcggccggtggtggagtcgccggtggcgcatgcgccgggcaacagcttccccagtggacacgcactcggctcgatggtcgtctacgggatgttggcgctggtgctcctgccggtcttcaggtcgtacggccgctatgtcttcctgggtctgatgggcctgatcgtcgcgctgatcggtttcagccggatcgccctcggggtgcacttcctctccgacgtcctggccggctggatgctcggcatcgcctggatcggcaccaccgcgtacgcgttccgggtctggcgccgggagagcggccagcgcaccgagaacgtgctgcaggagggcctggagccggaggcctcgcacaacctggagatcgccccggccgaggaggccgtgctgccgcacccgtgggccaagggcgccgagatcctcgtcggctgggtgctcaccttcggactgctgtacggcgtgggttacaccgtgacgcactggaacccgggctgggacaacgccttcgaccgctggttgcagaccttccgcaccccgggcctcgacaagatcagctgggggtggagcaaggccggcgacacccacgccatcctggccgtctcgctgatcttctgcccgatcgcgctggccctgtggcggcagtggcggccggtgctgttcctggtcctggccatgttcggcgaactcagcctgttcctgaccagcgccgccgcggtcggccggccccggccggaggccgcccagctggacgggcagatgcccacctcgtcgttcccgtccgggcacatcgcggccacgctctgcctgtggaccgcgatcgcgatcatcgtgctggcccgggtccggcagccctggcggtggatcttcgtggtcctcgccgtggtgatgccgctcggcgtcgccctgtcccggatgtaccgcggcgaacaccacccgaccgacgtgttcggcgcgctgctgctcgcctccgcctggatcaacgtgctgtattggacggtgcggccgaacgcccacgccgtgacggccaccgaggccgccgtcgagaacaagcaactggtggtcacctgatgcggatgatgacctggaacatcaagaccggtggggtggaccgggggcaccgtttccggctgccggccatcgccgaggtgatcgccgccgagaaacccgacatcctcaccctgcaggaactgcgcgacttccagcggggcggcgaacggcggatgcacgaactcgcctcggcggtcgggatgaccccgtacctggcgcggtccggcttcgggatgccggtcggggtgctcgtccgcgacccgctgcggatcacccgcaccaccggcgtcacctggcggctgcaccacgccgcggcggtcgtcgtggtggccacgccgtccggcccgctcaccgtgatcagcgcccacctcgacccgttctcgccgtaccggcggatgcgcgaggcccgctggctggccgcccggcacgccaggtcggcgcgggtgctgctggccggcgacctcaacggcctcgacccggtcagcgaccacaccgaggcgctggccagccagcagtcgatgttccgcaaacgccacctgtacccggacgggacggtcgacagccgggcactggccgccttcggtgacgccggcctggtcgacctgtggagccgggccggcagcggtgacgggcgcaccgtgccgaccaccgagggcggcggccgcgagttcggcgggatgcgcctcgactacgtgctcgccacccccgccgtggccgacggggcgcacgacatgcgggtggtccggggcggtgccgcggagcacgcctccgaccattatccggtacgcgttgacctcgacctttagacgcgtcgatactgtcgggcgtgcgcttgccgctggtgccgtccgccatcctgaccgtggtctacctggtcgggtacctcacgctgtcgatcgtctaccaccggcggtgggatgcccggctgcgggccgccctcggccggcggctcggcgccccggtcggctgggagtatcacgaccggtggcacgacccgctgagcgacgccacctccgccggatatcacggctgggcggctcagggtgacgcgtcgctgcggcagcggttcctggtgaacatcgcccacctcgccgtgctggtcctcgtcggggtcgggccgatcgcggtgtacctgttgatcgccttcgccggcctgatccacccgctggcgctgtgggcggcgctgttcctgttcatcccgatcttcgccctgttctgggccggccgctaccgctggaaccgcacctgagcgtagggggcgaatggccgtgacatcggatccgcacgtcgtccggcagtgctgctagcttgtcgatcatgatcgaccagctgacggtgccaccgcgcgtcgtcgtgaccagcaccgtctccggcctgatgatgatgagcttcttcaccctggcctgggtgtccaacctcttcgccgggtgggccgcaccggccgcctggtcggccacggcgatcgccctggcctgcgtgctctgcttcgtcgggcgggccgtccagctgatccgatcccgccacgccttcccggccgagttgtccgaggaacagcagcggcaacggcgtaccagcggccggactttcgggctgctgttcggcgcggaggccgcggccatctgggtggtggtgctcctgctcggggccaccggcaggagcgactacgtcgtcccggccatcgccctgatcgtcgggctgcacttcttcccgatggcgcgactgttccgccgccgtgtcgatctctacatcgccgcctggacctgcctggtcgccgtcgccggcctgatcctgaccggcgtcaccgacctgccggcggcccgggtcgacgcctgggtggcggtcggcgccgcggcggcgaccgcggcctacggctggtacatgaccgggacggccggcgacctgctgcggcgggcggcgcgcggatagtccggacgatccgccaccgtcggggccggcgcaccgccggtcaccggccgggcgcccaccggctcaggatcggcccgccgagggtccgggcgccccagcacatggtctggccatacccggcgaacacctcatcgcgggaatcgaagcgaccgagatcggcgagcaccgtcgcggacaggtcacacgacgagcagccgcccggcgtgctggtcaccccgtcccagtccacggcggtccgcgccaccgcgtcgaagagggtctccccgccactgttggtgaaaccaccgccgccggcactcagctgctcgaccgaaccgaacaactcggtgaccggcacccaccggtcgtcgagccggaactccggccaggccagcagcacctcggcgggaacgagacggcgcaaccggggaaaccgcggataccagaaccgcccgtccaccaccagggcccggcaacgggtggcgacacccgacgcccgcgcgaccgcctccagcaccgccagccgctgactgcacgatccgcggccgcgggtcagcgtcaccgaaaccggctgctggtcgtcgaccgcgtagaccgggcggacccgggcggcgatcagcgtgtgggcggaccgcagccggtcccacgggtcggtgacggggccgagggcggccagcagttcggtcagcggcgggctcggccagtcgaggatcggggtggcggcggtgctgccggtggacggggcggcggacggggtccgcgtccgccaccagggagtgagcatccgagtggtcacgccgcattgtcgccgccgccggcccggacctgtcaaccggaacgccgggatcgccgcgactcggggccgggcggcgctcaggctagctagctagcgtcggccggggcgtggtggtgcgacgacggtcgggcggcgtgggtggtgtggccgcccccgacccccaggtcgtaggcggtctcaccgtggatggccaggtcgaggccgccgtgttcgtggtcggggtcgacgcggaagccgatggtgcggtgcaggacggtggcgatcagccaggtggcgccgaacgagaacagggcgacggtgaccgcggccgcggcctgccggccgaacagcgacaggccgccgccgaacagcaggccgcgggggccgccggtggccgtggcggtggccagcaggccgatcaggatggtgccgaggaagccgccgacgccgtgcacgcccgcgacgtcgagcgagtcgtccagtccgaggcggtgcttgaggcccacgacgtacccgcagagcgccccggccgcgacgccgatcagcagggcgcagagcgggttgaccgagccgcaggccggggtgatcgcgaccaggccggcgaccgcgcccgaggccgcgcccagggtggtggcatggccgtcgcggaggcgttcgacgagcagccagccggcgatgccggcggcgccggacgcctgggtgttgaagaaggccaggccggccgagccgttggcggcgagtgccgaacccgcgttgaagccgaaccagccgaaccacagcagcccggcccccaggacgaccagcggcatgctgtgcgggcgcatcggatcggagcggaaaccgagccgctgaccgaggacgatcgccagggccaggcccgacgcgccggagttgatctccacgacggtgccgccggccaggtcgaggatgcgcaggtgggcggcgatccagccgtccggggtgaagacccagtgggcgatcggggcgtacaccagggtcacccagacggccacgaacaccacccaggtgctgaacttggcgcggtccgcgatggcgccgctgagcagggccgccgtgatgatcgcgaacatcatctggaaggccgcgaagaccagggtgggggaggagccactgagcgagccgggaccgatgccggtcatgccggccagcgtcaggccaccgatcagaccgtcgccggcgtccggcccgaaggccagcgagtatccgtacagcacccagatgatgctgaccaccgccaggcaggcgaagctcatcatcagcatgttcagggtgctcttgatccgcaccatgccgccgtagaacagcgccaggccgggaatcatgagcagcaccagcgcggcgctgaccagcagccaggcggtgtccccggagtccaggtgagcgggcatgctttcctccagggcgcggcatcctacgatcagcgggatacagactcgccagccacggtttcgggccgggacctcatgcgtttccgctgtgttacggacgtcatccggaggaaagtgaaggcctgtcgcgcggcgttgcgccgtccgggaacgcatactcgctcccatgacgatcgagtttccgtcgccgacccgtccggccggcggcaccgccgaggtcttcacgggctacctggcgtacttccgcgagacgctcctcgccaaggtcgcggcgctccccgagggggagcgccgcggcagccggctcccttccggttggtcgccggtcgagctcgtcaaacatctgcggtacgtcgaactgcggtggatcgagtggggattcgagggcgtggccttcgacgatccgtggggtgaccgcaacgtcgaccgctggtacgtgtcgccggacgagtccttcgccgacctggccgaggcgctgcgcgcgcagggcgcccacaccgacgcggtgatcgcgaagaccggcctgtccgcggtcgggcagcccggcccgcgctgggacggcgccgagccgccgaccctggagcgcatcctgttccacctggttcaggagtacgcccggcacgtcggccacctggacatcgtcgtcgagctctcggtgggcgccgtcggcgagtgacggcgcgctcaggcggtcagatgcgcgaccacccggtcgcggccgctgcgcttggcggcgtacaggttgcggtccgcctcggacagcagcgtggacagcgtcccgtgcccgtccggcgaggtgatcacgccgatgctggtggtgacggggaggctgccggtgatcggtccccaggcgtgcgcgcggatccgcaggcgcaggcgctcgcagcggaccgcggcctcgtccgccccgatgccggggaagaccagcaggaactcctcgccacccatccgggcggccaggccggcgcccgggatggcctcctccagcagctcggcgacgtgctgcaggacggtgtcgccggtggcgtgcgacagcgtgtcgttgacccgtttgaagtggtccaggtcgaggatcgccagcgacagcggggtgtgccgctcggcggcctcggcgagcagggcgggaacccgctcgttgacgtaccggcggttgtagagcccggtgagggcgtcccgcagggccatctcgcggaagtgctcgctggcccggcgggcctcgttcgcctcgaagacggcctgcagggcgcgggcccgggcgtcccgctgcaccgacagcagcgcggtcgtctccgcgtggaacacccggtgcgcctcgtatgcctcggcgaaccggccggtggcggcgtacagcgcggcctgctcctcgcggatccgggcgcggaccgcggccagcccgcgctcctcgcagatgcgcaggttgtcgtccagggcggtctgcgcctccgggtagcggccggccagccggcgagccagggccagggtgagtcggcactcggcgatcgcgtcaccctcgttggccgcgaccaggtcggccaggaccggggtgagcagcgcctccacctcgtcgtagtggccgcccatcagctcgacccgggccagggtgtccagctcgccggcgccgaaccggtggccggtgcgggactggatgtcgtgcatctgggcgaccagcgcgcgggcggtcggctcgtcgtcgttctcgtaggcgctgtagaccatgttgttgagcgccatgatggtcatctcatggtcgccggcggcgatggtcagggccagcgcctcccggcagcggcgttcgccgtcggcccgggaaccggtctcctccagggccaccgacagcgacatcaggtgctgggcgcggatcgtggtggggaagtcgtcgcgcaggtgcgcgacgcactgcacggcgtgtttgagaccgtcggcggcgtcaccgacgaaccggtagaagaccgacagctgccggtgggcccgggccagcagatacggcgaatcgtgctgttccgcccagacccggacgcggtgcgccgtctggccaccctcgccgatccggccctcgcgcaggtccaccgaggcgagcagcagctcagcgcggtggtacagctcctcggcgccgagctcctcagcctgccggcggatcacccgggccggttcgatcaccgtccggaactgcgagtgcgggcgggtctcgaggtccaccacggcagcctccagggcaccgagttgagccaacccggtggggacacagttcgccgtctccgtcgtcactgtccctacttcctgctgtggtcgccgtgacggtcaacactccggggcccgggtggcagggtgggtcccggacgggtgcgatccggttgcggactcatcgggccgtgcagaccggggcggaggcggcgagcgcgccaccggccgactgcacggcgaccgtgaagcagtagtcgacggcgctgtccaggctgtagacctcgtagtcgaccgcgccggccggcaaccgctggaactcgccgggccgctgcccggcccggccgccggagatcaccacccggccccgcgccgaagccggatagacccaggtcagcgatacgctgtcgcccctgtcccgcagggtcaggtgctccggcgcgccgggggagccgggaccggccgtggtgacggtcggccgggccgcggccgccggctagctagctagagcgcgggatgcccgccccgacggggccgggcggggcgggcggtgccgatcggcacggggcgcccgtccgggccgtactccggagccttccgcccgggcagcgggggtggcgtgtcggcgcgggcgtgccggccggcgggatcacccggcaggctcaggtcgctcagatagaacggctgttgatagaccgtgccgttcgggtcggtcgccaggttgtccggcggcggctgaccggcgtcgtcgaaggtgtcgtccggggccggcgggaatcgccgcgacccgctgccgaccgcgtccgggtcgggcaccgtgggacggcgcggaaacggccggaacccgccggggcgcagctcggtgtcgtcgtcgcgcgacggccgggtcatccgtccgcaggtgtgccggccggagcgttcgccgtcggccagcgcggccgcctgcagcgcgagcggatggtccgccggcaggtactcgtggctgagccgcagcgcggtggccaggtggtcgcgggaggcggcgtcccggccgcactcccgctccatcgcgccgagccgggccagcatcttgatcccggccggtgactcctcgccgtaccggcgccggtggcgccgccaggcgtcggtgagccgggcgcgggcggcggcacagtgcccggccgcgtgctcggcggtggccaggtcggcctcggcggccagcacccgcggcgcgtccgggtcgtcgacgtgcgccagctcgccgaccaggtcgtgatagaccagggcggcccggccgtactgcccgatccggtgcaggacggcggcgtgcagggcggccgcggcgatcgtccgctcgtcccgcgtgccgtgcaactgctcctcggcggcgtgcgcgaaggcggcccagagccgggccgactgcgggtcgccgagcgcgatcagcacccgggcgaacagcgcggcggcggtggccagctcggcggtggcacggcggggatcggcgtcggcggagcgcagcacctcggccagcacggcccgggcgccggcgagatccccggccgacgacagggactgagcctgagcggtgagttcggcgaggggaggagccacgtacctcatagtgctcggatgaataccctaagtacaagtggtgggtcgcggcggccggtgccgagtggacggggtagaacagcgacatgtcagtcacgacggtcaagcgcgagctcctcgtccggcacctcgaagcgtgggccgcggccgcggtgcatcgcggccgtagggccatctacgtgcacggatacgccgacgtggacggcggggcaagcgccgaggcggccgtgcgggtgctcgccgacctgccggacctggcccgcgggcgggaactgtccatggtggcggtgggtgacgacatgacgacaatcactccccggctgggcgaggtgcagcagcaggcgggtgccggggccggactgtcggtgctgccgatcgccgccacggtggaggtggcggtacgggcggccggggccaagaacgtaccgacgctgggctatctggacgccggggcggcgagtgaaccgccggcggtgcccaccgtggcgtgccttgccgccgggaaaccggcggaggtgctgctggtgctgccgcccggagcatcggcggatccctatcggacggccggttttccgctgctcaccgcggccgagctggcgaccggggaggaacccgggcaggtggtggtgttcgcgaccgggtcggggaagagcctggaacagttcaaggaggcgctctgggcggtcgacgagttcgccggcgtccggctgcgcgacccggccgacccggaacgccacctcatcgacatctcgctgcagccgcaccccggcccgctccgccgggagatcctggcgtacctgggccgggtgggcgcggcgacggtgagcgacctgcggacgttcgcgctgaccgggacggtctaccgggcggcggacgcgaatcgcgtgctgcacctgatgatcgacgccggggtggtcgcgcgcgagccggcgcacggccggctcggcggggacgtgctgatcagcccgatctagctcttgtcctgcttccgagatctagctcttgtcctgcttccaggacagcgggccgggcaggtcgacgcggtgcgcgcgggtgcgcgagttccaggaccagcggccgatcttgatactccaggacgagaaaccgttctcggtgaagttcaggatcagcgggccgaacttcttacggctgcggaacatgaggcccatcggaaacgctcccatcgtgctgcttcgtgatgggcggacggttcccgatcgcgtcgatccacaaacgtcagcgtggctgccaggcgtccggccgggtggtcagcttgcgcacgtgcgccggcatccgcccgctgacgagctcggccaggctcacctcgtcgagcacctcacggaccgcggcccggaccgcgacccacaggttcggaagattttcggcggcccccgtgtactgcgtctcctcgggacgcagaccgcgcaccccggcgagtgggccgtcgaccgcccggatgatctggccgatcgtcacctcccgcggtgggtgggacagtgtgtacccaccctcggcgccgcgctgagcccgcaccaccccggcacggcgcaggtcagcgagcaccgcctcgaggaacttgcggggcatttcctggtcctgggcgatggcctgggcggacatgagtgacgggtaggcctgagccaagctcagggcggcccggaccgcgtagtcgccgcgcgcggagatctgcacgcgactattctgccccctccgcgccgccccggtgcacataccccagggcgatgtgggaattaaccctccgccagcgagtggtcatcctcagtcagcgggtggtcgttgcccgggtatcccggtcggacgctcgtggaagtcgccgcggaaatggcccggactcagcccggtctcgcggtggaagaaccgcccgaagttggtcggttccccgaagccgaggacccggccgatctcggcgaccgacaggtcggtggcggccagcagccgccgcgcctgcagggccacccggtcgtccaccacctgtttcgcggtccgtccggtgatcgccagactggcccgggtcagcgtgcgcaccgagcagcccagctcgtcggcgtagtcctcgacccgccggctctgctgataaccgtcctccagccggcggcggaaccgctcgaaggtgcggctctccacattgccggagtcgtggccgccgccgtccagcagccgcaggcgcaacagcagtgcggcgagctggtgccggagcagagcccgggccacctcgccccgggcggcgccggtcccctcggcgtcggccgccagttgcgtcatcgcggctttccaggcgcccgggtcagggagcaccaccggagccgtggccggaccgtccggatcgtcgggatgcaggccgggcaactcgccgggctggaacaggccgggccggaagacgaccgtggtcgtatcgcccgtggtcgtctcccccggtggcgtctttcccggcgtctttcctggcgtctttcccggcgtctggaagcggatggcctggccggggcgcgcccagagcagcgttcccggtccggccagatgggacgtgaaatctacgtcggcatgcactggtcccgtggagatcagcacgagcgcgtgacactcgagcaggccgatggcggatcccgccgccaccggcagggcacaggcaccgacccccgcccaggcgggcggtatacaggctggtacgcgctcggcgcgatgaatgagtgctggcatcgacgctgacggtaaccgtcgatcggcgtcgacgcatcccttactgcacttaccggggtatttgtctgtttcgtgcctcggtattcgctatacgtccgattccgatcccttttcggagatcccgacttttcccgaaaaaaggacgacccgcacggatcggcagtgtccgtgcgggcccggtgatctaacggacgtctgtcaccgaccggcgagcaggcgattcaccgccgcatccacgtccaggtgttcggattcccggccacgcggaaccaccacataggtgcgccgcaggaatcggaccaggacactgcgcggcacctcgaacagcgcgttgccgtcaggcgacgacaacgccagagcgacgaagtcccctcgcggcgtggcccacggccacacccggacatcgccgatacccgcgggctcgtcgagcccggtaaccagcagttcccgcgcgaaggaccagctcacggcttccccaccggctgattccgcgtggaacaacacatggaccgcatacggatccgacgggtcgtaacgcagactggcgcgcaccggcagtgccgtcgcgtctggcgctacgagccgcagcgaggtctcgacctcgacggtcgttggacgaatggtactcatggacgaactccccccggcaccgctgcgaggctggtgaaccccgcgtttcccatactcaggtgatccctgtcgttacgctccgccatacgctgatctcacccagtagtgggaagacggttccgaaaacccctccgcccaggacgcaaaaagatatcttgtcctgttctgcccatgtactcggttccgcccggcgtcgggtggtccagcagttgacttactccggtaacgtccattcctcccgggtagtgacggggcgcccggacactgggggatgaaatgggtgtaaaaccggacgacagggctacggacgtgcgtctgctcgaccgtatccgttccacccccggcgggcggctcgctctgaagatcggcgtcggaaccgtcggcaccctggtcgtcgccatcggcatcgttctcatcccgttcccgggtcccggctgggccatcgtcatcctcggcctggcgatcctgtccctcgaattcgcctgggcgaaaacagtcctcaccctcacccgccggcacgtcaaaacctggaccacctgggccgcccgccaaaccctcgccgcccgcgccgccctcggcgcgctcggcctcgccttcgtggcggcggtggtctactacacggtccgcctcagcctgcacatcgacctgatcagggtcggtcgcgacctgctgccgagcgaatgacagggacccggttcgcgggggtgggacggggtccggtagagttccatctcgttgagggcgattagctcagcgggagagcgctccgttcacaccggagaggtcactggttcgatcccagtatcgcccacatagtcttctagctgcaaaaatacccgctacagagatcatctgtagcgggtgttttgtcatgattttgggagcgaacggggagcagcggcaccggttggatggtgacctctcccaaaacacgatttgtccgctccctgcgtgagcgccactatgtcgccaaggtggtcaccgtttcgcggtgtcctcccagcgcttttgcaggccgtcgacgagtcgttgttcgacggcggggctgacatggctgtagatgccgcggactccgggtaggcggtggccgagtcgtttggcttgcgcgacctcggggacgccgtcttcgatcatccaggtcttgtgcgtgtgtcgtaggtcgtggaaatgcatgccggggatgacggggacgatcagcttcttcgggtcaccgtcggtggcgggtcgccagaagcgtcgggcgaagttcgagcggcggtggaggccgccgtcggcgccggcgaagacgtggacgtggtcgcggctgtccagatgctcacgaagccgggtgaccaggaacggtggtagcgcgatggtgcggacggcggcgggggtcttgggtggtccgagttcaagggtgccggcgatctcgtggagggcccccactttcgggtcgatgtggatgcgggcgtcccggaggtcgcagttgtgtcgttgcagtccgaccagctcgccccagcgcatgccggtgtaggcggcggtgatgacgagggtggcctcgggctggttgaggtggctggcgatggcgagaacctgggcgggggtggcccaggggcgttcggctttcgggacggcggcggggcgtagacggcggcaggggttgatggtgatgcggcgttcttcgacggcttcgcccaggagcatggacagcagggcgaggatgtcggtgacagtggccggtgcccggcgctggctgagctctttgatccaggtccggaccatcattcgggtgatgtcgttgttcggggtgtcgccgaagcggggtaggaggtggaccttgaggtaggtctggtgtttagcggcggtgcttttgctgacctggtgggcggccagccacaggtcggcccattcgcggagggtgatcttgccgccgctggggtcgacataggtgtcctgctgctgttcggtctcgacggctttcacccggtcctgggcggctttcttggtggtgtggctgctgtcggtgccgaccgtgccgtccgggcgccggtagcggacccggtagccgtcgccgcggttttcgacccatgccatgggttctcctgatgtccgtaggtgtgggtggtgaccgtggtagtggtcaggcgtccatggacgtgcctgaccgtgccgggatcaagccgggtcgtccgaggtgctggagcgtgctccggcggcgatgatctcggctaggtcttccgcggtgaagcgcaggtagcggccgatgaaggtgcaggggattcagatggcggccaccggcaacgtgttatcgaacatgagcaggtctcgtatcgacgtgttgcgtccagtcggacgggacgactatgggcagggagaacggacagccttgaggcatgcgaccactgcggacggtgggtgtgcacggcgaggcgctcacgtgcggacgctccgctgagtgccattctgcggttggtgggagctcgggagattgcagtccgacttggggtgtctcggcagaggatccaacagctggccgatcgtgacgacttcccagcgccgttccaggagttgaagatggggcgtgtctggtgggagcaagaggttgaggaatggatccgaaggtggcagtcggggtagtcaccgagtggagtcgctgatcacggaagcaagaacgctgcccagcagtcggccgaacgggtcgctgaccatcttgccgagcggagtcagatcttcctcgaagaggatcagatcgacgtactcgcaacattgctatgcctgttcctcggcaataacggacagacggcaggctcagagaagccgtaccgccctgcccagttgcacaccgatactgcggacggcatccggtgaatgggcgagcgcggacgtggcgctggacacttcaccgggcgccggctgcgcccgaggccttgagcctgctacttgaccaggtgcgtggcatcggcctgcgcaatcccgcccatgccgccgagcatctgctgtccctgctcgctgccggaccgtatttcgaccgtgggatagaggccgagctatggattttgctcgccgagttacttaaccagcaggacgacatcactaccgggcttaccgccgtacaccgagccgcccagcttctcgaaaccgatgctcgcacggactggtctcgcctgatcaccttgctcggcgtcagcgcggacctcagcgtccaagccgacgactcctccgcggtggaagtctgcgaccactacctcagtgtcatcaccaacactcatgctgcggatccccagcgtctgataacgggacgcgctctgcgagcagccgccgcctaccaccgccgctgcgactacggccgctcgcaactcgacagcctctgccgtgtcgcttcccgccatagtcctatgaagcagatgctggaagccggcgtcgaggcgatgcgtgatcgctgcaggggagtcctgcccccgaccccaacccggatacccgcactacccggtggtttgctgaatccgcacctctccagggccgacccagacttcttcgcataccggatctggcatgtacggacacgcggtcaccattgtgattgacaggcgcattgacggatctgcacccgcccagggtagacccggacttgatcaaagcatggctgcctggtgttcgatactgctgaactttttgttggcgacgggcgtgtaccagtgcgatgggtcagaccgtcgtctcgtcgtatcagcagttcaccagcctgcagacaggtgacgtccagccaggtcccggagcagcacgtctgcgtgcgggtctgctctcctcagcagggttgcacacgtcgcgctgtatctctccgcgcctgtcaggctacctgcgatctgcggtcgcgtttcgcgactcttgtaaggtgtcgggttcggtctagaacgggggagtggttgaacgtgcagcctctggttttgcaggtcgatgtcgaagcgttgcacggtgcgggtcaagatgtggcagaggcggccgcgaccctgcaacagacgctgaagtcggccggctccggtctcgcgcctgcaccccagacgggttccacggcgacagcagccgcgcagaaagcggagacggcgtggctcgctgatctgcaacggctcgccagccacgtcgacgaatacggccgaactctgacaacggcgtcgaaaaagtatcggtccactgatcaggcgagtgccgatgcgttggaagccaacgggccggaggtgggtcgatgagtggcctgacgctgcaagacctgctcgagttcgacgccgggccttggcacagtgcagccgacgtctggcagcaggttgcccgcggtctcgataccgcgaccgaccagctgatcgtgggcacccgtgatctggttgcggtgtggccgcacggcggtggatcggaagcggctcgccagaaggctgccatgctgcgggccgagttggaaaatacgtatctgccagcgaaacgcctggccgacgcgtttgaccagcacgcatacgcgatgaagagcctgcggagccaggcggagggaatcgtcgagtcggcgcggcacgctggctacaccgtcgactcggtggccgtcacgatcaccgcgcccgcgtcggcgtacatgggcggcgacctcgaccggaccgggcgggaaaccggcaccctgctcaacgacctgcgccaagtcgtggagtacgcacgcgcacaggacgacgcgacggccgccacgatcaacggcaacgtgccttcgcctcagaacggtttcggcgccagtccgccaggcgcagctgcccgggctgaggaactagcgaagaagctcctggactcgaactaccggcctacgccggctgaactcgacgaactgcggaacctgatcaccctgtacggccgagacaaggtcttcgactacgactttctgaccgcgctcggacccaaaggcttgctgcaactcaatggcgtgctggcgacctaccagcccgacggccccggcaaggacgccgacgggtggatgttcagcaacgagactgctgacacggtccgtgacctgcagaacggtctcggcttgatgctggcgaccgcgaccgagcacaccggcacccagaccggtccgcgcggggatacctacgtgcccggtgatcacgagctgtccggccagtgggttggcgacctgatggccgccggacgcagcaagatgaccgtcgtaggcccctacggcccgcctcaagatgtcaacgtctacgggtatcagctactaagcccgctgctccacaatgggtcatacgacgctcgattcctgactgcggtcggcggggacatggtggatttcgagatgtcacagggcaagaacagcggactgtggaccgctgaacgcggtgacaacctgcgcctggactggacccatggccatgacgacaataccgtggcggccggctacgaccctatgaacggcctgatggacgcgctgtcgcgcaatccggaggctactcgagacctgctcaccggtgtcaccagtttctccgcggacggcccggtcggcggtcggctggaccggctcgactacctgctcaccgaccggaactggaacgcggacgttcccggtggctccggctggtcgaacgaggtgatgcagcacggcggcgactacaagagcaccgcgctcgacgacttcggtaccgctctcgaatctgccaccactggtgagcccagcccgcaagcccggcatatcgtcgagtcgatcatctacgagaccggcgtcgacgagcaggctcagggctaccacaacggtgttatccccggtcacggcaagagtgaggacttcgcccactccgacctcatccagccgcagctgcgccagcacctcgcaaagatcacatccgcctatatcttcgacgtgaacctcaacatcgcggacggccacaatgcgatccccggccagaccctcgatgtcgaccacaaccacctggtgcgattcctagccgacctgggcaaggacccgggagcacacgagacgatcgccaaggccgaggctgcgtacgcggcaggcagctacgacgagatcctgtctggccggcagaacccgcacaacggccttgaccgcaacctgagctcgatggagaacgtctcgcacaactacggcagtgtgatgggtgcgctcgacaagggagcgaacgatgttcaccacatcaccagcgcccaactggacgaggcctacaacaacaaggtcgagagccactacaagatcgctggccgcttggtcgacgaggtcatgggtaaggtcaccagtaagatcacggtgccggtcgccggtgacctggccaaagagtacgtcgacggcctgatgtctcaagccgaggaacaggccaaggtcgacaacaccggccacgtcacgtacgaggtcggccagtcgcttggggccgccagaaacaccgcggtcggcctcaccgaacaagccctttacgacagcggcaaacttgaggatctgcctgagcggctcctggtggacggccatcccaagccggtgagcgcatgggacggcgacgatatcaaggaatggcagcggtggaaggcacacctcggccagagtgtgctgggtaatgccgccaatagcgccggggacaactatcaaaagggctacgagtgggcgggagagattctcaagtgaggagcaggacgagccggtccaagccgacgactctcggcgtgctgcttgccgccgtgacggtcggtctgacgacggcaagttgcacgagcgatgatccgcctgcgaccccaacggcttcgcatgcgacacccgtaagctccgctaggcccgtcctgacctacgacgaggcgtacaggaagttgccgatgaacgggaccaaggatctgccgatcacctgggacctgtccaagacaccggacgtcgacgcggtcctcggagcacgtcgaggtctggtgtaccggtactgggatttgagtgcgaccgactcgaccacggtcagcccgatcgggcgattcgtttacaccgagcggtactaccagcagttcctggcacccttcgcgacctcgacgagtgacaacccgtcgatcggcccgatctgggtcaaggtcatgggcgtcgagacgaacagcgcggatcgcatgacagtcacgttctgcgccgatctcggctactggcacgaggcccagcagaagaaccccggagtccgcaaggggcgagcgaaccttgagtcttacgtgatgcaggacgtccagagcagtgacggcgaacgtcattggctcgccgatgacctcctcgataaggatccggaccgtaaggcgaaatacggtacggagtgcacggaatgggctcaacaccagccctaagagggcgtctgattcacgtagtttgtgtgttatgccgttttaggtgtcttgccaggttggggtggtttcgtcgacggctctcttggtgaggttgtcgatcatggcgatgcggatcattgtggccgaggtggccgggagagtttcgtagtcacgcgccaggcgccggtgttgcatgagccatccgatggtgcgttcgacgacccatcgccgtttgatcactgagaagcctttgacctgcgggtccgtggtgactatctcgacgtcgacgccgagcgtggcgccatgttcgacgaccttggtgcggaagccggcatcgccccaggccttcgtgagagtggggtagatgcgggtggcccggtcgagtaggtcgatgccgatcgtgttgtcgctgacggaggcggcggtgacgatcataagatcatgcacgcgcgatgcctgagaagatcgtccgctagtgcgttgaccacgaacgttcaccgggtccgatccgtcaggcggccttcgttcggggtcggccccagcgttgttgacgttcgctgcgaacccgggctcgttcgcggcgttgcgcggccaggacgtcggggtggcgggcgttggcgttgcgccagcgcaagtatttctgcagcttgcgagctaagacggtgtggttcgggtggttcgagttcgccatggtgaacatgcgcagcggcccgaactgcgcctcgatcgggttggcccaggacgcgctggtcggcgtcaggcatagctcgaccttgttacgagcggcccaggcccggatggtcggcgttttgttcgccgacaggttgtccatgattacgtagatcggtgcgccgtccggccgcgctttccggatcgatttgagcgcggacagggtgtggtctgcgcctttgcgtcgccggttcacgccccagagctggtcgtcgccgaggctgtagcagccgtggaagtagcggatgccgtgcgtgcgatggtaggtcgccggcagccggtccggatgcgttcgcggggcccagccgcggccgtggttggggcggatcgacaacggccggaactggtcggacgcaaagctgcgggtcgggaattgggtggtgacttcctcgatccggtcgagtttggcgtcgaagtccgggtccttcgactgcttccaggtccgggtccgctgccagctgacctggttgcggcgcaggatctgtcgcagccgttcccggccgatgatgacttcgcgagtggcgtcggtggccagaaaatcggcgagtttgcgcaggctccagcaggtgaagctagctagctagcggccggtgacccgcatgaggccgagcgctggtttcgaacctcttcggacgcgggacattcgttcggtcgacgtcgcctgctcaccttcctgcttgatcatgaccgcggcgacgaggcgtgggaggtggcgcggctcgccgcggatcagcggcaggcgggatccgtacgggacgcggtcgacctgctggtccgccgcgacgggcatgccggcgccgctgagtggctgacgccgcgggctcaggacgacgactgggaatccgtggtactgctcatcgaacaggtggagctgagcggacaggcggatgctgccgcggagtggcgcctgcgggcggcggaacgcggtcacggcgaggtcgcccggcgtctggcggagagctacacggcagcgggcgatcatgtgcgtgccgccgccgtcctatggccatccgccaccacggaccgcagatcggcggggaagctgctcggggtgctggctgccgccggtgacattgatgggctcgagaagctgcaccgcacgcgagttttgcttcgcttggcgtacggggtgggagagctggcggacttcctggcctcgcacggccgggaggctgaggccgaggatgtcgagcagtacggcatcgagccggacggctccacggcgctgaagtggcagataccggacgacgtactggagaccttcgccgcggccgcggtcggtaaagccgtggctgaacaacgatgagcggcacggcgggttcttcgtcggcgcacgcaacggcccttcctcgaggagttccgcgcggtccgtaatgtaatgaggccgctccatctcgtgaaaacggtagccgtcgaggcgggtgcgcccggtcagctgtcctcgggcgacgatgacggataccccttcggatggcacccgggagagctactccggcagggcgagacaggcgctggcggcctgatccgcgtcagcgcccgcgagccggccgccaccggggggcgacgtgccggcgggcgacgcacccgcggtgtagtccggggtcgccggcacctggccgagccgggaccagacgccgatgccaccggcgacgagcacgactgcggtgcccatggcgatcatcgcctgccgccgccgtcgcgcgccctgcttggcgcgtagctgggccaggaccgcctcagggtcggggtcgtggcgcgacaggacgtcgcgcaggtgggccggatccatcgggtatcagcctcgttccgcagttgtcgctgccagccgcagggccgtacgggcatgggacggaacacccctcgttgtggagggtgtcgcgggaagatccgggattggttaccacacgggtcggcctccggccgcgacggtgctgtccccggagggaacggtccgttgctgccttccatcaggtggagtcgctgcaatcgggtggtctgtggccggtcgccaccgccgactatcgtgaccacgaccaagtcgccgtcgagcgcatctttcaagccctcgcggctcggggctacccgtcaggtacgacggggacgccgcaactgttcaacagcgagaaggtgcgtgaccgtgggctactggggatacatcgtggctatccgccggcctcaagaccaggagcgcagcgttgcgctcgacgctttcggcgaacaccagcaagcagtcgctgacgaccaccatggctggctggtccgccaggtcttcggtgccgaaccagatcttgcacgcgcggtcgcagccgttgccactcacactcaggcgccggttgtcggggcttacatcctggacagcgactgtgccgtcgtagaagcggcagcaccgggaggcgcacgatggtccgccgtgctgaacccgaacagggcagctgaatacggcgctccggctgtggcaccggaaaccgcggtgacggcggcggcaacatgggctcgagcggcgcagctgccgtatgacggtgacctgatccggcaggtactcgccagcgaggagaccttcgcggaagaccaattcctggctttgctttccgccatgccggcaaccgtcgtcgcccgctgagacgtacgtcgtgacggggaaggggaggaagcgacgtggccatcgatctgatcgtcgatctcaggagtaggaaaatcgagacgctcgacgacttctgggatgccgtggcgaagccctgcggactaccggcatggttcgggcgaaacatcgacgcctggcgcgacacgatccaggcgagagggatctcggacctcgtcgatcgccacgatgcggtcgtcgtccacgtcgatcgggcaggtctcttctcccggaaggaccatgaggccagagcgttgcggcaggccttcgccggccgccgttcgcgactcgtggttcatcagccaccaccttcggtaggccaagattgatcaacgatggacgccgtggctccggattgccccgactgtgagacgcgatggcatggccgaggcggtgcgctcggcggcgaggtgggcggacagcccactcccgggccgggccgcccgggtggcgcgccgccccggcgatggcatcggccgctgaggcggtccgccccggccgggcggacccgtcgtcgccactcagctctcggcgagctggccgttcgtggagatccacggaagcgcctgcctgaaggcctcccgccagaacgtgatgttgtgtttgcccggtatctgcaaccattcgacttgcattccggcggcctggcaggcggcacgcacgtcctgctgctgaggtagatatctgtggtcatcgttgccggcggcgaggaacgcggcggtcgtcgggaaacgggtccgtttcatgatgtccaaggggttgatgcgggtgaaggccgcgttgtcgccgccgaagacccgctgcaccgtggtgacgtgggcgccgagggtgggctcacgctggccggagatgtccacgaatttgccgtagagggagggcgcgcgtacggcgagttgcagcgcgcacgtgccgccgtgtgagtagccacccacgaaccactgctgtcggtcggaggcgacctgcaggtgggcccggatccacgccggcacgtcctgggtgaggtaggtctcgacattgccgagcggggagtcgacacacagcgggttggccgtcgtggcgccgaggtcgtcgacgacgaccacgaccggtgcgaggccgcggtgggcctgggcgaacgcgtcgagcgtgtcggcgaggcggaggttggtgagccattgcttgggttccccgggctggccggccatcagcaccatcacggggaggaccggtcgcgggaggaccgcgtacgccggcgggaggtagacgtagcctgggcgggccgggaaccgggagacgaccccgggaataccgaccgggtagacgacgccgtgcgccgggatctgctgggtgggcttccaggagtcgatcagcatcgttcccgcggcggccgtgaccagctcgctcgggggcacgccgccgggcagcggccgggcccggtcgctgtgggcggcttcccgcagggcctccacggtcgggtacatgccccagtagacgttgatctgcaccgccgaggtggtgacgacagcgagggctgccaccacggcaaccggccgtaaccgccaggagagccgccgcagccggacggcggccagcgcgaccgccgccaagcccaccgccccccagacgaggtcgtgggtggggatctcatcggggaacggccgccacaccttctcgacggcgatgtcgaacgcgacgaccgcggcgacggccgacgccaggacgatcggtacgacccgggtccagaatctcctgtcgcggcgagccaacaatcccacgaacgcgatcgcgccggtgatggtgaccacccacggcaaccatcccgtcagtagcgaccagtcagccaccctgtctcctcatcctcgagcgggcacatcggcacgcagccacctccggctgagcgcggtgcgttacggcgacgctcgctgagctgccgcgcgatcgggcgcgccgcgatcctcgcagcacggtcacggccaaccgcagcgcccggcgcaccgtcaaccccggcaggtaggcgcgcatgacggctcgaccgatgcggggcagggacgtgacgtcggggtaggccaggtagagcggcaggtacaccggctggaacttggccttgaacgcctgcagcgcccgcgacccgtataccggttccagcagccgaccggagtgctccagcaggcgctgcagtcgcggcacgcggcattcgtgctgggccgaggtcagcggtgtgccggacaggctgaggaattcggcaccctcctgcttgaactgcatcgccgccgtcgcgatgaggaactccatgacgccgttcgtggcttccggccgtcgacgcatcatatccagcgtccacccgacggttgcaccggcgcgatagacgggaagccaactggtgaccgcctggacgcggtgctcggcgtcgaccgcgatcaggcatcgcacgcggtcgtcccgcagctcgtcgatgccgccgagagtgaaggtcatctcgggcatctccttctgcgccatccacgccgcggagatctcctcgatctgctcggtgatcgcggccgcggaggccgggaaggagatccagtcggccaccaggccctcgcgccgcgcgcgattctgcgcggtccggatgtcctgccagcggcgaccggtgaactgcaggagctccaggggaacccgggcgtcgtcggccaccctcaacaactgccagccgtcggtggccagcagcgtgctgacctcctcactgatgctgtacaggcagggcgtccagccgttgctgcgacagtgtgcggtgaattgccgcacggcaccgcggatcaggctccgctcgccgatcggatcgctgatcgtcagcgcgaccgagcccaccagccggtacggcaccaccacctggccgtccggagtggaccagtgtcgcacgccccgccacgtcgccatgtaggacagcgaggagccgccgaagcgccgcagcagcgacagcgcgttggggcgaccgggagtgggatcccggcgctggaccggcgtaccgcgcatcgagggcggcgcctccgcgaccggagccaccgagcggtggcgctcggcccgtttgaatcgtgttcccgaatttctctgcgagtggctcaagaagtatccccgtagctttcgacatgaacgcgcaccgcgaccggtgcaggcgaagggtgaggaccgctgcggccagcggtccagcatcgaggtacgtcatgcctccaaaggcttctgtatggacggtcgcacacgaccgctcgcccaccggacagtccggaaaggcgccggcccggatcctgtccggcagcttccctccgtgacgcacggacatgtgcggcgttcactatggcaagatcgtgcaaccaggttctgagcacgacatttgcgcttccccgcgtactcacgcgcccccgtcggccatcggccgaaggtcgtcgtcacctcggtgttgagcgtcaggttcgcgggcactgacccgtccgtggtggactcatcgcgcatggtgacggccggtctggtgcggatcgtgcgtcatctgcgacaggagggcgtgatccggactgcgcaccgacagccaccatcgatgctcgagaaagtcagtcaccgtccgccgtcgcggtgcgccgacaaggcagggtcggccgctattccttgatgccgatgctgtggatcggcgcgatcctgagcaggcgcccgaccggcaggatcgtggtggccagcgcgaggaaggtcgtaccgccgagcacggcgatccagcccagcgccggcacgtacggcatcaggttgccggtcagggtgccgacgacggtggtcagggtgccggccgcgatgccgccgccgatgaccagggcgatgcccagcagtccgacctgctcggcgtggaccatgcgcttggcctggcgcgcggtcacgccgaccagccgcagcagcgacagctcccggcgccgggccagggccgccatcaccatggtgttggcggcggcgagcgccgcgtagccgaccatgacaccgatgagcagcttgttgagccaggaaccgagggacagatcggcggcgagccggtcattcaggccgaccgtggtggcgatcgcactgcccgggtagcgggtggccagggtggcgagcgcctcggcggtcgccgcgcccggctcggtgcggatcaggatccgctcgtcgagggcgttcccggtgtgcccggtgaccgtctgccggggcagtgtcacgtcgccgaagccgaggccgcgctcgtagacggcgacgacccgcggcgtgaccggggtgccgtcgcccagccagaaggtcgcccggccgccgagcgtccagccggcactgtccgcctgcaggcgggagaccgcgacggtctcggggcccaggtcggacagccggccggcgacgacccgcaggtccagtgcggcgtccgcgccgtccgggtcgatcgcctgcgcctcgaccggtgccgcggattcgctcgccgtgagcaccgaggtgtgctggacgccgacggcggcccggacgccggggatgcgccgcgcctcggcggccgcggcggcgggcaggcctgcgggcgacacgagggtgacgtcggccagggtgccttcgcggttctggctgaccgtcgcccgctgcacgttgtcctgcaggaaccacaccgagccgccgaacccgacggacagcaccagcgaggtcagcaccgtggtcatccccttggcgttcgccttgaggttcttggcggccaggtagccgctgggcccccagaatgcccggagcgcggggccgagcacgtgggcggccacccggttgatccagggcgcgagcagcgcgacggcggtgacgaacaggtagagcatgccgatggcgctgttcaccgcggtcgatccggaggtggcgccggcgaacgtcgccgcggcgccggccccgcccagggtcaggacgccgaagaccagccggacccggccgccgcccaggggctcggccgccgcctcgccgagcgcctcggcgggccggatccgggtgacccggcgagccgcgatcagaccggacaccatggacaggacgaggatggcgcccgcggcgatcaggaccgagaaaccgccggtgaccatggggaagctcgccggaaggaaaccccggtcgacgaactggtggtgcgcccagccgatggcgagcaggcccgccgggacaccggcggccgcgctgatcaggccgagcagcccggactccgcgacgatgatccggcgcacctggcccggggtcgcggcgatcgcccgcagcagcgccaggtcgcgtcggcggtgccggaccgacagcccgagcgtgccggccaccacgaacatgacgagcagcgccacgtatccgccgaaggtgccgccgaccgcgatcagcaactcctcgggagccgccgggtcgtgctcggccctgccgaggttccggccggagtaggcgtcggcgccgtcggcgtcggccagcgtgccgatccgggcggcgaggtcgtggacgtcgacgcccggcgcggccagcacgccgatcgccgccgccctgccgggtgccgcggagagcgcggtggcccgggcatcggtgaagaagacgctcgccggtcccgttccctcggcgatgccggtgaccaggtattcctgcgggacgccggcaacgagcagggtggtgcgtcgccccggttcggcgccgcccgcgacgcgggcgtccaacaccacatctcccggcccggccggtgggcttccggcaatgattttgtacggcgtgagcaccgcactgctccacccatgaccggtggcgggccccgccaccaccacggcgacctggtggtccgcgacgaccgtggccacgccgggaacgcggcggatccggtccgccagtgcgtccggcacggtgccgccggcaggcaggtcgacggtgaccgtctcctcgccgccggtctgttccggcgtgaaggccatggtgtggcgggcgacgaccacgtcggcgccggcgtactggccgggtggagcctggtagcgcagtcccgactccaggagcgcgcccatggcggtgagcagcgcgacgcccgcggtgagggcgagcagcgtggcgatcgcgctgccgatccggcggcgcagcatcgcggcggcgagccggatcatcgccgcatccccgaaacagcctgctgaccggccgggctctgcggaaccgacgaccccgccgggaccggccggcccagcgtgccgagttcctccgcgatgcgggcggcgcccggctgcggcatgtcccgcacgatccggccgtcggccaggaccacgacccggtccgcgtacgacgcggccaccgggtcgtgcgtgaccatgatgaccgtctgcccctgctcgctgacgaccgcccgcagcagggtgagcacctccgcggcggtctgcgtgtccagtgcgccggtcggttcgtcgcagaagatcaccttcggccggacggccagggcccgggcgatcgcgacccgctgctgctgaccaccggagagctcggccgggcggtgccggagccgctgaccgaggccgacccgcgcgatcacctcggtggtccactgccggtcgggccgccgcttggcgagccgcagcggcagcaggatgttctcctcgacggtgagcgccccgatcaggttgaaggcctgaaacacaaagccgatttcggtacgacgcagtttggtcaacgccgtctcggagagcccggacaactcggtgtcgccgatccacacccgtccggacgtcggccggtcgagcccggccgcggcctgcagcagcgtgctcttgccggagccggacggccccatcaccgcggtgaacgtgcctcgctcgaacgcggcgtcgaccccgtcgagggcgatgacctgctgctcacccgcgccgtacacgcgcgagacctgttcgacccggacggcgatcgcaccggggtccccggactgccggaagcgagcgagcatgagttttctcctgacgaagtggaccagtggaacgcccagaacgctatgcagcgccacgcccaagatcgatccagtcagcccgccacccgccggtagtgccagccctaccttcccccgccgggcgcgcccggtagccggccgcgcccggtagccggccgcgccactcaccggcaaccccttccggctgtgccgtcacccggccgcggagtcgatcgagatcaggacctcggtgagcgtgcgtcgcaggtcctcgtcggtgccgatccccccgaactgcccgcggcgctcggggcgggcgagttccgcccggatctgcggcgcggccggggcggcgtgccggcccatccggcgcaggcatgccgcgacgtggtcgacggtccggggatcgtggtgccaggcttgccgaagcgtgtccagcacggtggtggcctcgggctcgccgccgatgtcccagagggctgcggcggcgtggacgcggatcccgtcgtggtcggcggtggacagggcccgcaggcggggtagcgccgccgaggccggtggaccgatccggccgagcacgtcggccgctccggcggcggcgtgggtgtcgagcagtgcgagagccggcgacaggatctcgtcgtggtcaccgctgaccgcctggagggtggtgatggccgcgacccgggtccacgggtcgtcggcgccgaccgccgccctgatcgccgggagtgcgccggccgctgccggaccgagcgcgcccagcgccgtcagcgcggcgctcaccagcgtccggtccggtcgcgctgccgcggcggtgagtgtttcggtgagcaccggcagcgaggagggggcgccgagggttgccagggcggccagcacgccgcccacgggggacggccactccccggacaggtcggcgccgatcaggcggtcacacaggcgtggcgccagctggtgcgcggcatctggcagggcgcccgccacctggacggcgcgccaggtgtccacgtcgtcgtcgaaggccaccaggaggctgggcagcgcccgcgggtcgccgaggcgggccgatgccatggccgccctctggtggaggcggcgcagatgccggcgcggggtgacccagccgtccggcccatgggcggcgaggaggccggccagggcttcccgggcgggctcggcgatcgggtggtgccgctccagcagcgtcgccgcctcggccgcgacctcgaggttgcgcgcgccgagctgggcggcgacgagccggatcaatgcggtgtggtcgtggcggaagtgccacacgagatcgtcggccatccggatcgcgtccagccggacgccgggatcgggactgctcaactgctcgatcagcaggtcggtgcgctgcgcgacccgggcgcccagcagccggtgcagggtctgcagcaggtccgtggtcagcgcgtggcaccggttgtggcggtccaggtcctcgaacgcggcggcgacgaacgggggcacgccgtcggcgggcggctcgaccggcggtggctccggccacggctgctccggcggcacggcggcggcgatctcgcgcagcagcgcgagcacggccggcaccgggtcgtcgtcgatcgcctccggggtgcacccggtgtggtggatcagggcggcgagccggaactcgggctcaccggccgggtcgctcgccagggcggcgagccatgccgtcgcggcgggctcgatcaccggcagccgccgggccagggtggccgtcgtccgggccaccaggatgcgttcgatcaggcaggacgtcatgccgcagcggtcctggagcgcggtgagagagcggtgtgcgtcgtcgaccagcacgccgaggccggggatggcggcctgacgcacccggcagccggcgtccccggcgaagtcgaggaacgtcgccgcgtgcgcccgcaggaacgccacggcctcgatgtggtcctcgccggcgtagcccgcgtcggcgacctcggccgcgttcgtgccgatgttgaccagcagggcgacgatcgcggcccggtccggggtggccggatcacgggccagggcgaggaggaagggcaggctcgccgtcgtgctggaatagacggagccctggtggagcaccttgttgtagtagtcggcgagggcccggccgcgccggtcggcgtccggggagccgagcgcctgcagtatcgccggcacctcttcggccgatccgtaggcgtgatccatcgacgcccagtcgacatccgctgttccactgaccatgcccggcactatgccgggacccaccgacattttcgtcgcgtcagccggccggtcgggtcgaggcgaccgccgactccaccgcgtcggcgatccggcggtggccggcggcgttggggtggtcgccgtcggcggccagcagggacgtgtcgtcctcggcgcccgagttgcccttgaacggggtgaacaggtcgacgtacgtgccgttctgggcccgcgcggccgcggcgatctgcgtgttctccgtccgggtgagggagatgctgttgcggacgtagtcggcgccgtgggtggcgcccacggcgccgtcgaggaagacgttccagtatccggtgatcagcaccgtcgccgagcgggtggcgagtgccgtcctgacctgtttcaacacgtcggcgagctgggactgctgtgccttgagggcgggctggaagcagctgagctcgggtgcggcgcaggagtcgtcgtcgaccgagccggtgtcgaagtcgttggctccgatggtgatcaggaccaggtcggcggcggcgatctgacggcgcaccgtggcgtcgccgagctgggtgagcaggccggtggtggtcaggccgccctgggccaggttcgccacgtcggctgtcctgctccgccgggcggcctcgtcctgggccaccagcgacacgtacgacgtgcagccgcagacgctgccggccggaattgagtcgcccagcccgaccacccggtacggcccggacggcgtcgtcgccgggggctcggcggccggcccgggggactgccaggaggcgacgagcgaggccgcggacgagacgatcgcccggggtcccgcgacgagcacgagcacggcgacggccagcgcggtggccgccaggtaaccggcggctcggcctgagcgggcgacatgacggggcacgccggcaacagtgcccagatctgctgtgcggtcaccagtgtttcgctgtgagcgcactgtgcgtgtcgcaggtttacgggcgtggcgacccatggtcatgcggcccggcgccccggccctgtcaccgcgcggctcgttcctcgatatcgatcaatgcagctgatcttcatacggcaggcccttccgcgcgtccccatgatctccgccatgatggcagttgtggacgtcgccggtgggctcggtgtgtaaaacgttcgtcagaatgcggcccttgcgcggggtctcctcgtatccggcggcgcgatccgatggctgacgcacctcggtgcgatcgcacattcgatgaatcgttcggtagcggattccgggggccgctccggtcccgacggatgccgtgcgagcgcatccgccgggatcggggtcggcgggtcagcgggccgagcaggtggccgaggtcgggccgctgccggtgccctggaagccgaactgggtcttctggccggcggcgaccgagccgttgtagccgacattggtgaagctcacggcgccggtggtgccgctgccggtggtgctccacgagttggtgacggcggagccggccgggagggtggtggcgacggtccagccgttgatcgccgacgagcccgcggtgaccgtgacggtggcgacgtagccgccggtccacgagttcagcgcgatcgaggcggtgcagccggacggcagcggcggctgcgacgacgggggcggggaggacggcggtggcgacaccggcggcgaggacggcgggaccgggttgttgtccaggccgaagaaggtgatcgccatcctggcctgaccggacatcggcagggagtggccgaccccggcgatgctgatcgcctggaccggcggctgggccgaggagttgccgtagtaggtgcgcgtccagccggactgcggagtgtcagtgcggaccggggtctggctgacacccagcacgttggtccactgcttgatctcctcgccgaagttgttgtagttcagcgtggtgtcggcggtgccgtgccacaactgcatgcgcgggcgcgttccggtgtagccggggtacgagttgcggaccgcgtcgccccactgggccggtgtcctggcgacctggccgttcgcgcaggcgctgttccagccggcctgctgcgacgggtcggccgggttgcccgcggtcgcctggaaacaggtgtccggtacgcccatgaaggccgcgccggcggcgaacatgtccgggtagtcggcgagcagcacgttggtcatcatgccgccggacgaggcgccggtgacgaaggtccgggccggatccgtggcgtaccgctgctggacgtatttgaccatcgagctgatgccgaccgggtcactggtgccgttgtgggtcagcgcgcccgccgaggagacgtcccagcagttgccggtgcggaccgtggaggggtagatgacgatgaatccgtactgatcggccagcgacttgaactcggtgccggaatagaacgccgggccggagccggtgcagtagtgcacggcgaccaggacggccggcttggcggccggatgatcgggcacgtacaggtacatccggatgccggtggggttcgtgccgaatccggtgacctcggtcaatgccgccgcagccgccggcgatgcggggacgagcgtggtggtggccaccagggcggcgaggaccgcggccaccgcggtcagcaggtggcgccagtgtcttctcatggacgcattccttagcggggcggggaggtggggacgggaagggtggtgatccctgatcggagcgaaacattacaagcgggttgcgacaattacaacgctcaatatttgctcttcgcgccacatgatctcggcctatccgtattcacctgcgacaatgtagtgtcaatgggaagatcgagttccggaagtttcggtgatgggctccgaaaaagcgggggtagtttcgggcggcggggatgcgccttttgtcgtggttgctgccaagaaagttcagggttgccttagaaatggccggatccggccgctgatcttcagggcccggttaagctccgagccgctccgagcgggcggaaggcggaatcggcatggtcggcagcggtaggcgggcacggtgcgtcgtggccacgctgctcgggatgctcgtcctgccggccgcaccggcccgggccgtgaccaccccggcgaccgctaccgatcgggacttcgtccggcgggtgcacctgaccgccaccgcggtgggcgcggccagcgcgctggcccgggggatgagcgggaacacctcggtcaagaggttgacggcgcaggtcaccccgcagtgcgagcagctcgacgggttgagccgcagcgtggccgggacgctgcgggtggcactcaccgatccgctggccgccgagcagcagagtgcactcgcgacgctgcagcagagcggcggggaggctttcgacgccggatacgtcgactatctgtggcgggccgacagcgcgctgctgccgatcgccacgacggtgaagggcactacccgcaacgcggtcgtgcgacggctcgccgaacgggccgaggcggtcaccgcggaacagttgccgatgctgcaggacagcggcctgctgagaatgacggtgctgccgacgcccgcgacgcccgcgacgcccgcgacggccgcgtcggccagcgcggtcggccggctacccggcggggtgccgatggaccggcggctgatggcggaaacgcgctcgggcaccgggtatctcgcaccgccgatatggctccggctcgcggtgctgatcatcgcgaccgcggtggcgggggtgctgtcccggcgtctgctcacccggcgtcgaaccggccggccccgccgccgctgggcggcccggcggagtcgcggcaccgggcgcggcagtcccgggcggcattcccgggtgcggaggcctagctagctagccggcgggtgcgggcctcagtgccaggtcacgctgccgtggcggagctgggtggccatcagggcggccagcaccaccaggtcggcgatgcccagcgcgacgccgatcaggccggcgttgcggctcgggctgccggagccgtgccggcgggcggtgatcgcgccgagggcgatggcggtcgggccgaagacgatgttgaagaagaacaggccggcgacgcccaggaccagcgagccgacggcgcggtcgtcgaggctcgcgacgcgtttgacgaagttcatgtcgatcccttcgggaggtggtgggtcagcggcgggtcagggcggtggcgcgacggacgccgaacaggacggcggcggccaggaccacgccgaccgcgatcagcaccggctggccggtgagcagggtcgggccgacgagcagggcgatgagtgcgaggacggtcatcagcgcggccatcgtcgccccctttcagttgacagttgtgtactgaaacaccatagctcggggaacaggtgtttactgagtgacatgagccaccaccatccgccgcccgccgaccggctcagccggccggagcagaaggcgcgcacccggcaggcgcttctcgacgcggcgctcgccctgatggagcaccgcgggctgggcagcatcggcctgcgcgaggtgacccgcgcggcgggcgtcaccccgaccgcgttctaccggcatttcccggacgtggacaacctcggcgtggccctcgtcgacgagtgcctgggcagcctgcgcggcactatccgggcggtccgggacggggtcagccccagcgacgaggtgatcaaccggtcgatcggggtcctcgcccggcgggtgcgggagaatcgggagcacttccggttcgtggcccgggaacgccacggcggggtgccggcggtccgggccgcgatcgccgagcagctcgacctgttcgccgccgagctcgccaccgacctggccggcgacaagctggtgggcggcccgcgcttcgaccggtggatcgccaccgacctgcgcatgatcagcagcctgatggtgaaccacatggtgtggaccgcggcggccctgctggacgccccgcccgatgcccccggcgcccaggcccgggtgatcgacacggccggccgccagctgcggctgatcctgttgggggcccgctgctggaccgacggggactgacagaccttcgagcgcttcgcgcgatgggtggtacgggtgttcagctcgcgccccgcgtccgcgcccggcccaattggagtgccggatctaggctgcgggcgtggatgcgggtggcgcgacgtcgatgctggcacggctggtggaccgctcggtggagcggatcggggagatgtctgccggcggccggtggttcgaccggcacgaggccgggatgatcgccgaggcctgggccgaccgggcccgggacgtgttcggcatgctcggggtgtggccccgggtgatgcgggaccgcaaggccaggacgatcctgcggcggatggccgacagccgcgccggcctgcgggactggatggtcgcggccggtggccccgggatggaccggctgctcgggccggctgccgcggagccgccgttctaccgcgacttccggggcagggtgcagccgggcacggtgtcgtccgacccggcggggatcgccgaggactacgacctggcccgggcgcgggtggcgtcggtgtgggccgagcgggccggggacggcctgcgggggagtgtccgggtgctggtgccgcgacggtatgccgacggcgaggccctgctgacgttcggcgccgaccgggtgcgggacctgtggttcgacagcgcggacggggccgggctggtggtgcgccggcacggcgacgggttcgaggtccggctcggcgcggagggggtcatgcgtaccgccgcattgtcgtgtttcccggtggatcagcagtggcatctgtcggcggccggccggaccgccgaccgggtgacctcgcggcgcaggccgccgacggccgcggacctgttcgaggactgggcggacggcgcccggggcgacgcgggggcggcattccaagcggcggtgcgccggctcgggagactgcgcgttccggaggagatggcccgcattccggtgggcgagctgtgcgaggcgctggtcggcgccggaacccgggcgctggccgccgccgacctgccgtccgagcagcggttcgccgcctggcgggacctcctggcccggtggagccgggtcggcccggacggccccgaggccgagggcgaactgccggcgggcgtccggctggccctcgtgacgtacgaggcggaacccgccgtgctgaccgcgatcttcaccggcgcggacgacgagcggctggccgccgcgaaactcccgtggccccaccgtctgctgctcagcggccaggccggcgagctgaccctgcccgacaccgcccacggcgcctagggcagccggcgaatccggcgttcgggcaggcccggcagctgcccggcggtgcggcgcgcctggccgcgggcgggtcgatcaggtatcggatcactccgggcccgcgccgacttgacggcgagatagtaagcgcgcatactaaatgcatgaagacgatcgctactgctcagatcacctccgatgtgccggctcaggccttcttcgagcggtgggccgacatggccacctggccggagtggaacaccgacaccgagtgggtgcggctcgacgggccgttccggaccggggcgaccgggcagctgaagccgaagggtggcccggtgacccggttcgtggtcagctcgctggtgccggggcgcgagttcaccgacgtgtcgctgctgctcggggcgcggctgaccttccagcacctggtgtccgtggacgacgccggggcgaccacggtgacggtccgggtcaccctcggcgggccgctcgccttcttctggaatgcggtgctcggcaagggcatcgcccagggcatcgacgcggacctggcccggctcgaggcggcggcccgggcggcgggggtggcggtgtgaagcactggctcggggtggtctgccgggatcatgtgcggcgcggggtcgagcgggggatcgcccagctcgggcacggcaagcgggcggggctggcccggctcgccgccggtgacggattcgtctactactcgccgcggaccagtctgcgcgacggtgcgccgctgcgggcgttcaccgcgctcggggtggtcgccgacggcgagatctggcaggccgacgagggggacttccagccgtggcgccgccggatcgactatcttccggaggtgtccgagaccccgatcgcgtcgctggcgctcgcgttcaccgcgcagccgggctggggcatgcagctgcgtcgcggcctggtgcaactgtccgaggcggacttcgggcggatccgtgccgccatgctggcggtgggatgagcctgaacacccggcacgacagcgccgacgacagccccggcctgctgctgtggcaggtgaccaaccggtggcaggccgcgcagcgggcggcgctgaaaccgttcgatctcacgcacgtgcagttcgtgctgctggcgacgctcacctacctgcaggcggaggggccggtgacgcagaaggcgctggccggccaggcggccaccgacccgatgatgacctcccaggtgctgcgggcgctggaggcccgtgccctggtgcatcggccgccgcatccggatgaccggcgggcgcgggcggtggcggtcaccgatgccggacgtgagctggtcaaccgggcggtggtcgcggtggaggagtgcgatgccgcgttcttcggcggcctgggtgaccggctgcccgccttcactcgcggcctgctggcgctacgcgcgaactgaaccccaccgatggccggcgcggcggagagccgagccccgttgatggccggcgcggcggggagccgagccccgttgatggccggcgctgggggagtcgaacccccgtcgatcgccggcgccgtgaacagctgaaccccgttgatctccggcgctggaggaagccgggccgaacggatcgccggcgggcgggcgaattgacgcatgtgtcactgcgaggattgcgtccgtcgagcatgatcgccgggtgaacatgcgaccctccgttctgatcccgatcgccgccgccctggcgctggccggctgctcctcctcgaacgagccggatccggccaccgccccggtgtcgagcgccccggtgtcgagcgccccggtgtcgagcgccccggtcaagagcgctccggtccggagtgccccgaccaagacggcggccgcggcgcgggggaacgggtgtccggtcaccgccgccacgctgaacgccgtccacgtcccggacgccggcgacgtcaaggtcaaggtggtgtcgaagagcatcaagtgtgccgacggttacgcgcaggccgatccgggcgtcgagggcagtgacggcgttttcgtctaccgctatgacgccaaggcgaaggcctggcggttcctgaccgccggcagctcgatcgactgcggtgcgatcgccattccgcgcccggccggcgacaagctctccgtctgctactaccagtgaccgggcggggccgcgggcccctcacggaccgcggcccctccggacgcgatgacgacggtacgtcatcgtgcccacccgccctgacgaagagtgattgcccgaatacgttctgttgatcttcagttgtgactaacatccacgaacatcgaatcgatgtgcatcagtggggggtcgcattgagcccagatcgggtacgtggactacgacgctggatgaccgtgggcgcggtcgcggccgtggtggtggggatcgcggcgcccggggcgaacgcccagggcccggatgacgtgaccagccgggcgttcgctcagatatcggcgttgcagcagctcaagaagtcgatgacggcggccgagcggaagctcgacagccggctcgccgtggaactgcgccagcggtccgggcgggtcgcgacgagcgagctgcccagagtggacacccggatcgccgtcaccaagggcggcaccaccgaggtcgaggtgcacgccgaccgggtggacgccgcactgctcggccggctccgcgcggccggggccgggatccggtatcccagcgccaaggatcggtcggtgctggtcgaggcgccgctcggggtggtgacgacgatcgccgggtggtccgacgtgaccgcggtgaccgccgcgcgcggactgaccaccgggcacgagaccgacccgcgccgaaccgcgccggaaccctccaaagaggctcgtgcagccggcgtggaggcggctgtcaaggctgcggaaagcgtacgcccgctggccgtcgatcctcgtggttcggtggtgtccgaaggggatcgcacgcatgccgcggacactgcgcggacccgcttcaagatcagtggggtcggggtgaaggtgtgcgcgctctccgacggcgtggactcgctcgcggcctcccaggcgaccggcgacctgcccgccgacgtggacgtgctgaccggccaggacggttcgggcgatgagggcaccgcgatgctggagatcatccacgatctggtgccgaacgcgcggctcggcttcgcgaccgcgttcaccagcgaggtcagcttcgccgacaacatccgggcgctgcggttcaccgccggctgcgacatcatcgtggacgacgtcgtctactaccacgagagcccgttccaggacggcgcgccggcccgggcggtcaacgacgtgatcgctgacggggcgttctacttcagctcggccggcaacgagggcaacaagctcgacggcaccgccggaaactgggagggcgacttcgccgactccgggcgcgggatcgggaaattcgccggccgggcccacgacttcgacccgggtccgggcgtgcaggtgttcaacccgctctcgccgaacagcacccgatgcgtgacgacgctgtggtgggcggacccgctcggcggctcggccaacgactacgacctgtacctgctcgacgcggccggcaacgtcaccgacttctcccaggacgtccaggacggcaacgacgacccgttcgaggcgctggccaccggcaccgggaccaaccagcggctcgccgtcgtcaaattctccggcgccgaccggtatctgcagctcagcgtgttccgcggccggttcgccgacacgccgtacggcaccctcaagggcttctcgacgccgggcgcgctgcgcggacacgccgcctccgccggcgccttcgcggtggcggccgcgccggcccacgacgcgctgccgttcgacctggaggacggcgacccgccgaacccggccggaccgtacccgaacgtgttcaccaggcagaccgaaccggagcggttcacctccgacgggccgcggcggatcttctacaacccggacggcacggcgatcaccccgggcgacttcagctccaccggcgggctggtccggaccaagccggagatcaccgcggcggacggggtgctgacctcgatgtccggcttcgcgccgttctacggcacctcggcggcggcaccgcacgcggcggcgatcgcggccctggcgctgtctggcaacccggggctgagcaacgcggagatccgggcggcgctcaccgggaccgccctcgacctggcgccggccggggtggacaaccgcaccggcttcggggtgctgcgggccgacctgctgctgcgcgacaccggagcgacaccgcaaccgctggtcaagaccgggacgccgacggtcacgccgatcaccggggacggcgacgcctacctggaacccggggaacaggcgaccgtcgcggtgccggcggtgaacgtgggcgacgggacggcgaccggggtcagcgtggtcgtcggcgccgacgacccgcgggcgacggtgaccccgcacgccgcgtcctacggaacgatcgcggcgggcgcgacgaaggcgaagaactacaaactgacgctcgcggcggactatccgctggggcggccggtgaccctgaccacgaaggtcaccttcgccggaacgctgtcgccgaccaccgggagactcgtcgtgccgaccgggcagccggggacgagcgtgcgggacttcgcctacaccggcgcgccggtgccgatcccggacaacgatccgaccggggtcacggccaccgtcgacgtcagcggcgtcggctacgcctccgcgctgaccttctcgatcgacggtacggcgtgcagcaccgacgccggatcgcccaccgtcggcctcgaccacaccttcgtgggtgacctgatcgggacgctgaccgcaccggacgggcgggccgcgaccctgttctcccgcagcggcgcgggcggcaacaacctgtgccaggtcgtcttcgacgacagcgcgacggtggcgttcaccgacgccgagtcggcgaacgccccgttcaccgggacgtggcggccggacgggtcgctgtcgtccctgcggttgtcgccggtcgacggcacctggagcttccacgtggccgaccgggccggctcggacaccgggtcggtgcgggccttctcgctgcacctgaccggtttcgcaccggcctgaccggatcgtcgcccgggcgcccatcggcgtccgggcgacgctcagcgagaagagcgccaccccgcccgggaactcaccggtccggcggtcctacaggaaaagcatcgactggaagtacgaggggtcgctgtacgacccctcgtcctcgtgccatgccggcggtgcggaggcgacgaagttggccgccgccggatccaggagatagagctcgcggtcgccccagtcgccgccgacccggcgcacggcggcgtcgcgttcctcggcggaggccagcgcgacggtgatcccgtcgaaagtcggctgcaggagcatccggcgcaccccgctgaagatcaggtcgatccgggtcggctgggcggcggtcctggtgctgcgcagcagcagggtcgcgtggctcaccgagtatcgccagacctggaaggtgcgctcggattggaagatcacgacttcatcagctccagccagttcggctccggcatctcggcgggggtcagggcccggccgttgaggtaccacttgatgctgccccattcccgataccccatgcgaatgtagaagccgatctgccccatctcccagtccgtcgcgccgtagtcgccgctcttcgccttcttgtaggcgttgatgaacgcctccagcggcgtcgcaccctccatgtcgtcgagcgcgacgtggatcacggagcccgggttcttcagcgcgtcgttgaccttctcctgccagcccgccagaccgctctccgggttgatccccttcaggttgtcgccgttgtaggtgacggcatccgcggtctcttcgagcttgcggagctccgccgccaggccctcggagtgccggttgatgcccagcacgacgtttttgtcgcagttgtgcaccaggaccggcgtcctgccggccagcacgtagtaggtgtgcagctcgtcgacggtcaggttgaacatcacccggtcgccggagtaggcgcgaaccgccgcgacccgcggcgccgtcaccgtgctgcgcagccggtcaccgggccgcaggtccgccgcggcggtccaggaccgcgtggtcgcgtcccagaacgggtgttcctgagtggtccgcagcaccgcaccggagccgatcgtgacgtcagccagcgcggtgtcccggttgcggaacaaccgggtgaccggctcgcccttcgtcaccccctgcgccgggtcggtggccagcacccggtcgccgatggtgatctcggcgatcggcttggtgccgccaccggccagcagcacgcgggtgtcggcggtgaagctgttgcgggacaggcaggacttgatcagatcctcgagacccttgacgaccgggatgtcgcgcaggttccggaaggcctgctcgacggcgtcgatccccttgaccacgatggaccgggccatcgcggcgatctcctccgggctcagcgtcagcttgatcgcgagggactcggcgaggtcgaggatccgggccgcgttgagcgcaccgagcttggtgaccgcgttcgacagcagctcaccgccgtatttggcggccccggagatcagatccttgagacccgctttggcgatgtccttggagatgcccttctcgatcgccttgaagatcgagccgatgccgtcggtgccgaccagggtgaccacgtcgacgatcgtcatgccgagcgcgcgctgccagttcttgccccactcgtcccagtgcagcagctgcttgggatcgctgagcagcttgccgaagccgtcctgcagcgtcttgcaggccttgtccggcttgggccagaaggtgacgtccggaaccgtgtactcgtcggtcgccgggtccaggccgatgaaggtgccgaccgtgcagtcgctgatgtaccagaggccctcgaccatccccagcaggtcgtccttggcacccttgacgatgtccgcgccccacggcatccagtggtcgatcgcctggtcgctcttctcctgcaaccaccgcatccacgcggtctcggccgccgcctgctcgacgtcgtacgccttccaggcggtgtccatcagcgtcttggccagcccgctcatcccgcgggccatgtcccacacgctgttggagatgctggtgatcgtgccgctcatcttctcggtgtcaccggccagcaggtcggcgttgtccgaggccagcttcgccttgtcggcgaagccgcgggcgccgttgcgcgcctgccgggccaccccggcgttctgcccggctgcctgaccttccgccttggccgcctgggcgtacgcgccggcctgcgcctagctagctagagcgtgccgcggtggcgtccgcccgcgcccgggtggcatcggccgcgagttgctgcatctcggccgtgcccgggcacccggtgccgctcgggttgttcgggtatttgcaggccatgtcggcggccatcttgcgggcctcggccgcctccgcctccagctccttggagtgcgcgccgtcggccgacttcttcgcccggtcgatcaggtccttggtctgcttgccgacctgctggaagtgcttaccggcggccaccgaccggtcgtacgcctgcttcgcctcgtcgtgcttgctcaccgcgatgttctgctggtcgatcgcccgcgccgccgcgtcgtacgcctgcttctcgtggttgatcgcgtccgcggccgcctgctgggcgatctggcgctgacgcaccgccgtctcgtagtaggcctgcgccttactcacccggagccgggcgtccgccgccgccgcctcggcccgaagccgttgggcgtgcgcgtccgccgcggcggccttcgcggccgcggccagcttctcggcatgcacggccagcttctccgccgccgcctgctcccgctcggccgcctggcggtacttcaccgcgttcgccgcgtcggccgtcgcgtggtggtcggcgtcgagggccttggccgccgcctcggtggcctcggccgcgtgacacgcggtctcggccgcctgcttcgccgcggtggccgcgtcaccctgcgcctgcagcacctcgttccagtcgacgccgtgcgtcagcccggtgtcgatcagcgtctgcgccgcggtggccgccaccccggcctgcgcggtgacctggtcggcgttgcgtgcggtggtggcggattcggcgcatgcgtcggatcgcagcctggtcaggtcggcggtgtgcgtcgcacccccggcggcccggaccggcaggtcgctcgcgtaggtcgcgtcggcctgcttggcgtaccggttcaccagtcccatcgagttcgccgccacggtcagcgattgcgtcgcgctgatgctcgccgccacgatctgctgctgcgcggtggccgcccgggccgccttcccggccagcgtgctgaggttgccgaccgccgcggagcgggcggccagggcgtcctcgatctcgtgctgggcgtcggtgtcctgctgagcggcgatcgcgtagccgtggttgtagaactcggcgatcacctccgggtcctcactgtccagcgccagctgcccctgcgactgcacctcgtagccgccgtgcgcgaccatctgctcgacccgggactggatcagctgcgcctgctgctgggcgctgagcacgccctgcgcgtcggcggcgtccgcggcggccttgccgatcgcgatgaaatcggcgatcttcgcggcgtcaccggtggccagcgcggccgcggccttctgccgcaggatcggcgtcccggtgtccgcccagtgctgcaccagggcgcggtcctcggtggccttgatcttctggatctcgaccgcggccttgcggtagaccggcagacccttgtccaggaagtcccggatccgcaccggatcgttcgtgtccagcgccgcctgcgcggccgcccggaccgccgggtccgcgtcgtagtcggccaggtcctggcacagcatccggtccaggtcggcgtcgtcgaccggcccgtcggccagcggtggcaccgcggtggccggcccggccagccgctccagcatctgcgtcagggtcaacggagccgcggcggccggcgggacgctcttcggcggcgccgcgaacgcggcctgcgggacggcgatcgccaccgccagcgctccggcgatcatcggcagtgcagcaagtctcgaagccatgacactcccccgtgaagtgactccacagggcgtgcggccggctccggccgatcacgtgacggaccactgtggccgatcagtcataccagaggtcgggtgatcgacgcagcccggtgagacggaacgtgtgtcgatggtcccgtcggcatgtgccggcgcggtgccgcctactggcggtaggcggcgaggaaggtggcgatccgggcgacggcgtcgtccagcacctcggtgggggccaggaacaccaggcgcaggtgatccggagtgtccaggttgaagccggtgccctgcgagatgagcaggtgctgctgctccaggagatcgatgaccaggcgctcgtcgtcatggatcttgtggacggcggggtccaggcgggcgaacaggtagagggcgccggccggcttgacgcagtcgacgccggggatggcggtcaacgcctcccaggcgtggttgcgttgctcgatcaggcggccaccgggctggatgagctcgttgatgctctggtagccacccagcgcggtctggatggcgtgctgggccgggacgttggggcagacccgcatgttggcgagcagctgcaggccgtccagatagtcggcgtcggggccgaagccgctggtggccagccagccggagcggaaaccggcggcgcggtagaccttggacaggccgcccatgctgaccaccgggacgtccggcgcgagcgcggcgagggtgtggtgcacggcgccgtcgtagacgatcttgtcgtagatctcgtccgcgaagatcatcaggccgtggcggcgggccagctcgatcatggcgagcagggtctccggggagtagaccgcacccgtggggttgttcgggttgatcacgaccagggcccgggtgcggtcggtgatccgggcggccagatgctccaggtcgggctcccagcccgcggactcgtcgcagcggtagtgcacggcccggccgccgcacaggttcaccgcgccggtccagagcggatagtcggggctggggaccagcacctcgtcacccgagtccagcagcgcctgcagcaccatcacgatcagttccgagacgccgttgccgagcagcacgtcgtccggctggacgctgggcacgcccagggtctggtagtgctgggcgaccgcgacccgggccgagtagacgccccgggcgtcgctgtaaccctgggcggcggccaggttctgcaccacgtcggcgacgatcggctccggggtggccaggccccacggcgccgggttgcccaggttcagcttgaggatccggtgcccggccgcctccagctcctgtgcccggcgcagcaccgggccccggatgtcgtaccggacactcgccaaccgctgggcctgccgcatcgcgcctcctcggaaactcggcgtacccggggaacgatgccagtcctacgccagttcctccaccaaaccactctgagagaagagcgtgacctcggagaacaccgtgttccggagcacctttccgtcccggatggtgagcacctgcagggtgtgcgccacgtagcggtcgccccggcggacgtacgccgcgagggtcggctgcccgttcagcgaggtggtcagcgcccgccagtcggtgccgcgcatcgcgaacacccgcgcgcagaacgcggcatagtcggccacccctcgataccagttctcgtagggcggcatctccaggatcggggtctcgccgagcagccggaccagagccgggatgtccgccgactcgaacgccgcgacgtaccggtcgaggacggcgcggtcgccggccgacggctcctcggtcacgcgtaccgtcgccatccgggcccgggcccgctgcagtccggagttgacagcggcgaccgtcatgtccaggatctccgccgtttcggcggcgctgaagtcgaagacctcacgcaggatcagcaccgcccgctggcggggcgccaggtgctgcagcgcggccaggaacgcgatccgcaaccgcccgcgcccgagcagtacggcggccggatcgccggccagcaacgcgtccgggaacggctccagccagggcacctcgcggtgggtgagtggctgctgcgggtcgtcgctgggcgccccgagcccggcggggagcgcgcgccgcccccggctctccagcgcggtcaggcaggtgttggtggcgatccggtacagccaggtgcgcatcgacgcacgggactcgtcgaaccggtcgtaggcgcgccaggcccgcagatacgtctcctgcacctgatcctcggcgtcgtgcagcgagccgagcatctggtagcagtgcgccagcagctcgccccggtagccgagagcgacttgctgaaatgcgtcggtggagcgatgagtctgcggcacctcaccggtatataccgcgaacacaccctgacgaaagaggcacacaatgtcacaaaccgtgcaggaattcttcgacctgtcggaagccgcctggatcgccggcgacgccgacgccgtggccgagctctataccgcggacgccaccgtggtgacctccggcgcggcgctgcgcagccgggcggagatccggcagttcttcaagaccggcttcgccggaccgctgaagggctcggcgccgctggaccgccaggaatcgatccggtacgccggcgccgacgtcgcgatcgtgagcagcaccagcgggatccggatggcgggcgagccggaggtgccggccgaccggatccgccgggccacctgggtgctgacccgcgaaggcgaccactggctggccgccgcgtaccacaacagcccggcgtagccgcccgaggtcagcggcgcccggcggccatcgtctcgaccgccgccatcagcaggtcgaggccgaacgcgtaatagcgttcgacgtcgggcgcccgccggtacgtccgggcgaactcgatcatcatcgggtactcgtcggccggcaggcactccatctgcacccgtttctgccgccgccactcctccgcccgcccggccggcacgtcggccgggcggtccggctgcgccccgaccagtccgatagcgccgttgagcaggtacatcgcgatccagtacccctcctcgacgtcgaatccggcgtcggccagcagggccagggtgtcgttggtcgcccgggtgaagctcgccgcctgcgtcttgtccgccgcgtgcagcaggtcgggcaggcacgggtggtcccgcatgacgcccaccacagtctcgacgatcgcgcggagctgtctctgccacgggtcgccggcgctgcggtcggcccgcacgccgctgagcacgtggtcgacgacgccgagcagcagctcgtccttgttcttgaaatgccagtacagcgccatcggggtgacgcccagctccttggccaggcgccggatggtgacggcgtcgaggccttcctcgtcggcgaggcgcagggcgcgctcggcgacggccgcccgactgagtcgttctgctggggtcacttgacaaccatacaacgtacaggtctcatgtacgaggtacatgtacatcgtacaagtactccgtatagggggagactgtggaacagaaccgtcggtggtgggcgctggtcgcggtggcgctcggcaccttcatgacgtacctcgacaacaacgtggtcaacgtcgcgctgccgtccatccagcgggagctcggcctgagcatctccggcctggagtggatcaccagcgcgtacatcctggtcttcgccggcctgctgctcgccggtggccgcctcggcgatgtcctcgggcaccgggtggtgttcctgtccggcctcggcgtcttcaccgtcgcctcggtcgcggccggcctctccggcagccaggagctgctcatcggggcccgggcggtgcagggcatcggcgcggcgctgctctccccggccgccctcgcgctgatcggcgagttcttcccggacccgaaggagcgcggcaccgcgatcggcatctggggcgcggtcggcgcgctcgccctggccgtcggcccgctcaccggcggcgtgctcagccagcacgtctcctggggctggatcttcctgatcaacctgccgatcggcgtcgcgaccctcgtgctgtccctggtcgccatgccgcgcgacggcgcccggacccgctccggcggcctcgatccgatcgctctgggcacctcgtccgtcgcgctcttcgccctgacctacgcgctgatcgagggcgacgccaagggctggacctcggccgtgatcctcggatcgttcgcggtcgccgcgctcaccggcatcggcttcgtggtgcagcaggcccgggccgccgacccgatggtgaacctggccttcttccgccagcggatgttcaccggtggtctgctcgcgatggggctgtgggctttcggggtcttcggcatctacttctacatggccatctacctgcagaacgtgctgggcttctcgccgaccgaggcgggcgccggcttcgtgccgctggccctgatcaccgcggtcggcgcggtgctggcaccccgcctcgaggcccggttcggcgtcgcccgggtgaccgcgttcggcctcgcggtgatgggtgcgtcgatcgccgggatcgcccggtacggcgagggcacccactacctcgacctgctgccctggttcgccctgtacggcgtcggcggcggcctgctcatcccgctgagcaacgtggtgatcggcgcgctgccgtccgggcgggccggcatcgcctccggcatgctgaacgtctcgcgtgaggtgttcggcctgctcggagtcaccgtgctgggcgcgatcctgagcaaccgggccggcgccgcgaccggcaccgagctgcaccgctatctggtcggctaccagttcgccctggtggtggccgcggccctgatcgtggccggggtgccgctgagcctgtggatgctgcgcacggcgcggccggcgccgcagatcacgccggtccctgtcctcgagacggtctgagaatcgatttggcgacggccggtcactgatggtcgactccccgcatgagagtcagcgccgtggtggccggtcttgtcgccgtcctggtctccttctccggcccgttcgtggtggtgctcaccgccgcctcggccgcccacctgacggccgcccagaccacctcgtgggtctgggcgatcgccatcggcagcggcctgtccggcctggtgctcagcctgctcagccggatgccggtgatcaccgcctggtcgacgccgggcgcggcgctgctggtcggctcgctcagcgcgtaccggtacaccgacgcgatcggcgccttcctgttcgccgccgtgggcatgacgatcctcggcttctccgggctgttcggccggatcctgacccgggtgccgcgggggatcatctcggcgatgctggccggcatcctgctgccgttcgccctggaggcgttccgccagctccccggcgcgcccgcagtcgtgctcgcggtgctactggcctacttcctgggccggcgcttcctgccgaactacgccgtgctgctggccctgggcgccggcaccgcggtcgccgcgctccgccacgacctgcacctgggcggcgtccacctggacatcgccaagccgctgttgaccctcccgacggtcaacccctcggcactggtcagcatcggcctgccgctgctcatcgtgaccatggcctcgcagaacgcgcccggcctggcggtgctcaagaccagcggctacgacccggacgaccggctgctgctgaccggcaccggcgtggtctcggtgctgctcgcgccgttcggcagccacgggatcaacctggccgcgatcaccgcggcgatctgcaccggcgagcaggctcaccccaacccgcggcagcggtacctcgccggggtggcctgcggcgccttctacctgatctgcggcttcctcgggaccggactggtcggcttcttcaccgcgctgcccaagccgctggtcgccgcggtcagcggggtggccctgctcggcgcgctgttgggcagtctggccggggccctggacgacaagtcggcccgggaggggtcgctggtcacgctgaccgcgaccgcgtccgggatgaccgtggcccatgtcggctcggctttctgggggctagtcgccggcgttggcgtacacctgctgctgaatcatcggccgcgacgtgcgggagatccgcaaccagacgacgaatccccagatcacgaagcccgcgtagaccgcgtacagcaccgctgaggggtagtagccgaagtgcagcagctcggggacgccgaccaggtcgacggcgatccagcagagccagaactcgacccagccgcgggccatcgcgaaggtggccaggatcgaccccacgaagatccacgagtcggccaggtagtaccaccacgggaccgggaagccggcgccgaccgcgcggaagacgaagaagcaggccaccacgctgagcagggccaccgggagcaggatcaggcgttgccggcggccggcccagtgcgggacgaccgcgctgcccaggccgctgcggcggttgcggcgccagcgccaccacccgtacaggctggtgatcaggaagaagacctggcgggcggcctggccgtagagcggggtgccctgatcgttgcccaccgcctgaccgaggaagacggtgaacagcaggatgttgccgacgatcccgaccggccaggcccacgcgctgcggcgtaacccgaacagcgccgagccgagcccgaaggcgttgccgacgatctcccgccaatagatcgcctgatccgcggtcacctgccatttggcggtgtagaacgcggtcagcaggtcatcgagccaagtcacggctcatggtaggacgagcttccggatgggcatagtgagacggtgaccgcagcgatctcctgtcccgtgcagacccgtctctatgccgacgggaaggtggccgcgaaggatttcgggtacgccgagctcaccgcccgactccgcgcccatccgggcgcggtggcctggctcgacctgctggaaccctcggcggaagacctcgccgcggtggccgacgagtacggtctgcacccgcttgccgtcgaggacgcgctcgccgagcacgagcggcccaagctcgaccgttatccggatcacctcttcctcaacgtctacgccgtcgcggtgccggacgccgagggccggcccagcaaggtggagatcagcgcgttcgtcaccgagcgggtgctgatcaccgtgcacaaggggaagggcgacgtcgaccggctgaccgagcgctgggacgaggacccgtccggtctcgccgccggcggcggcgtcaattatctgctgtacgggctgctcgacgtgatcgtcgacggtcagtacgcggccgcccggcaggtcgacgaggcgatggactccatcgaggaccagatgctcggcgagggcggtgcgccccgcccggtccggatgcggggtttcgcgctgcgccgctcgctggccctgctgcgtcgcgcggtggccccgatgtcggacgtggtcgccgagctcacccggaccgacaacggcgtggtcgacgaggatctgcgaccgtactaccgggacgtcgaggaccacgcgaagcgctccctggagtcgatcgagcactccctcatccggatcaacgagctgatcgaggccgacctcaacgagcagagcaacgtcctcaacgacatcacccgcaagctcgccgcgtgggccgcgatcatcgcggtgcccaccgcgctgaccggctatttcggacagaacctgccctaccccggctatcagaagccgtggggtttcgtggagagcatggtgctgatcgtggtctcggccggtgccctctactactacctcaagaaacgcggctggttgtagtaccgtccggggctgtcggatccgcgaacgggggaacggatgaccacggtcgaccttgcatcggtggacctcggataccacggcggcgacccggtcctgcgcggcgtgaccgtgcacgcgcggcccggcgagatgctcgcgatcaccgggacttccggatccgggaagaccacgttgctcaccgcgatggccgggctgctggccccgacgtccggcgtggtcaccgtggacggcgcgccgctgggcgaccgggacgccgcggtcggccgcggcgtggtcctgatcccccaggagaacgggctcgccgcgatcctcaccgcggccgagaacgtctcggtcgcggtgatcgccaccggcggctcgccggccgacgcccgccgccggaccgccgacgcgctcaccgcggtcggcctggccgggcaggcgaatcagctgatcgaggagctctccggcggtcagcagcagcgcgccgcgatcgcccgcgggctggccctgcgcggcacggtgctgctcgccgacgaggtgaccagcgagctcgacgcggcgaaccggcagaaggtgctggagttgctgcgcgccgaggcgcaacggggcgccgcggtggtgctcgccacccacgacccggaggcggccgcggcctgcgaccgggagttgcacctggccgacggggcggccacctgggcgcgcgcctgagatcgtccacgagcccgtaagttgcggtccccacggcgggcccggaccccgccgaccggcacctgggcaccgacgagatccagctcagcgtcaacatccgccgcctgctgggcaccatcgcgcgccgccctgctcaagctgcgcggggtgagccgctccggcatgctgcggctggcccgggggcagcatctggtgccgctcggcgccggcgtgctgctcggcgcccgatcgggttcctggtcgcccggctgctgatcggcggcgccccgcccccgacccgggcgaccggccggccgcgctggtctggtccgcggtcgcggtcggcggcctcgcggtgctcgccctcgtcgagtcgaccatgctcggccggccggtggcggtgctgctgcgcccggcggcaacccgtggtggtccgtgctgaccgacgtggtgctgccggcgatcgccgcggccgcggtcttccaggccgggtgccggtgcggtccagggacggcgcaatgcgagaaagggccgaaagactctggtgcgttgatccgttgggggcccgcgtccgttctggtgcatgaggtagctgtgcggaagctgtggaggaggttcctgtggtggccatcggacggagattgaccgggctcgctgtcgccgcggtggcggtggtgctgctgcaaccgatggcggcgcacgcgaccgagccgggtgtgcccgacccgccgaaccagttgatcaccgacaccggcgagggcgccgtcacggccgccgaccgggacttcgtggtccgggtgcggctcgccgggctgtgggagatcccggccgggcagatggcccagcagaagtcgaaggacccgcggatccagcagatcggcaaggcgatcgccgcgcagcacgtggtgctcgacaagatggaccgcgatgtcgccaagaagctgggcgtcacgttgcccaacgtgcccaactccgaccagcagggctggctcggcgagatgcggagcgccgccgaaggcaccgacttcgaccagatctacatcgaccggctgcgcgcggcacacggcaagatcttcccggcgatcgccacgatccgggccagtacccgtaacgacagcgtgcgcaagctggcgcagcgggcgaaccagttcgtgatgacccacatgacgctgctggagagcagtggcatcgtcgacttcgcggggctgccgaccgcgccgccgccggccgcggcgacgaccgccccggcggccggggccggggccgggacgggaacagcgacgaacctgaccgcggctgagcagaagggctcgccgctcagctcgccggtggtcgccggggtggtgatcgccagtctcgccgcggcgttcttcatcacccgccgcttctggccgagcaaccagcgtcgccgtcgccgctactactgatcgcggcccgggtcaggcggcggtctcggtgcccccggggaccagggtgacctcgccgtcgacgtgctggacggtgaagagggtgccgggcggataggagcccagcacctccgggggcagctggaccgtgccgtcgccggcgaccacggcgaagtcctggccgtcgcggccctcggcgccgacccggccgtcgcggatggtgacggcgcggccgaggcgggcgccgacctcgttgtcgtgggtgaccaccacgatggtggtctcgcgttcccggttcaccgtttcgagtgcagcgagcacctcgtcccggccggcggtgtccagccgggaggtgggctcatcgacgagcagcagcccggggccggtggcgatgccgaccgcgagggcggcccgctgccggccgccgggggtgaggtcggcgagtttgcggcggccctggccgggcaggccgaccaggtcgaggatgcggtccgggtcgtcgagtgtgatgccacgggtgtgcgcggcgcggcgctgggcgagccagatgttgcggtgcagcgtcgcgtacggcagcaggttgcgggcggcgccctgcaggaccacgccgatctcggtgccgcgcaggcgggagatctccgagtcggagagcttgcccatgtcgtacgtcccgatgttgatccgtcccgccgacggccgcatcaggccggcgagcagtgcgatgagcgtcgatttgccggacccggagggtccgaccagggcgagggtctcgcccggcgctatggagagatcgaccccggccagggccaccacgtcccccgcctcggcacggtagatgtgcaccacccgccggcaggcgaccgcgagtccgttcatgagagcacgctaacggtgccggacggtccctgacgaccccgtaaccggggcacttagcatgtggccgtgcgcgacatcgccgtcttcaccggatccgcccatcccgaactcgccgcggagatctgcgagcacctcgcggtgccgctgctgccgaccaagatctcccggttcgccaacgactgcatcgaggtgcagctgcagggtaactgccgggaacgggacgtgttcctgatccagccgctggttcccccgacccaggagcatctcgccgagttgctcttcatgctcgacgccgcccggggcgcgtcggccggccggatcaccgtggtcctgccgcattacgcctacgcccggtccgacaagaaggacgcccctcgcatctcgatcggcggccgcctggtcgccgacctgctgaccaccgccggcgccgaccgggtgctggcgatgaccctgcactcgccgcaggtgcacggcttcttcagcatcccggtcgaccacctgcacgcgctgcgcgagctggcccaccacttccggggctacgacctgagcaacaccgtggtcgtctccccggacctgggcaacgccaaggaggcggccgcgttcgcccggctgctcgggatcgaggtcgcggccggcgccaagcagcggttcgccgacgacaaggtggtgatcaactcgatcatcggtgaggtcggtgaccgggacgtgatcgtgctggacgacgagatcgccaagggcagcacggtgttcgagctgctcgcccggctgcgcgagcgcaacgtgcgcagtgtgcgggtggcctgcacgcacgggctgctcaccgacgacgcggtgcagcggctggccgcggagaaggagatcgaggagatcgtctgcaccaacacggtgccgatcccggcgagcaagcggcacgagaagctgaccgtgatctcggtggccgcgccgctggccgaggcgatgcggcgcatacacaacggcgagtcggtcagcgccctgttcgtctgaatccggcccggaatccggcccgggtctgaacaactgggccggattccggcgaacacccctcacgcacgtcccgtaacacgaaaaatgtgcacatgggtgtcatggcttaccccctccggtacgcgctcgccgacctcgccctcgcgctcagccgcgccgccacggatccggccgaggtgcgatccacggccgcccgcgccgccgctgacatgatcggcgacggcgccggggtgcaactgctgcgcgacgacggggagtacgaggcgatcgcgtaccaccacgtggcggacgaccgttccacggcgctggccaaggcgctggaccgggccggccgggcgcccgacgacgagtactccaccacgctggccgccagccggcgtccgatcgtgctggccggcgactcggcggcggcgctggccgggccgggcgacgggatcacggcggcggtgctcagcccggtgatcgtcgacaacacgtacgccggctatctgatcctgacccggcacaccccggacgcgttctattcgacgcccgaggtggagctggcccgcgacatcgccggtgagctgtcgctggcggtggccggcgcccgcgcccaggagcggctgcgggccgccgaggagcgctaccgccgggtcctggagaccatcccggaaggggtgctgcagctcgacccggagggcgtcgccacctacgccaacgagccgatcggtgtggtcctcgggatgccccgcagcgagctgatcggggtgtcgctgcgcggcttcctggacaatcaggggcagaaggagctggaccgccggatcgccgagtgcaagcagggccggtcgacggtgggcgccacccgcctgatgcgcgccgacgggtcgcggcgcagcgtgcggatgagcatgatgccgatccgcgacgaccacggcgagttcgccggcgtgctctgcatgatcaccgacaccaccgaccacatcgacgcccgcggcctcaaacgccagctcgaccacctgcgccggctggacagtctgggccagctgatcggcggcctgtcgcacgacttcaacaacctgatgacggtggtggccggctcggccgacatgatcctgagccagtccgcggacggcacgccgcagcagcagctcgccaaggacatcctggacgcggtggcgaccgggcggaccctcacgcaccagctgctcgcgttcgggcgcagcgagggcaaccggccggaggtgattcccatcccggatctgctcaccgacgtacagtccctgttcagtcggaccctcggtgagcacatcggtctggacctggccttcggaccggatgtctggccggtgcgcgcggagcgcgggccgttggagcaggcgctggtcaacctggcggcgaacgcccgcgacgcgatgctgcacggcggcatgctgcgggtggcggccaccaacgaggtggtcgagccgggccagctggccgagggcgcgccgaccggcaagctggtgcacctggtggtcaccgacaccggcaccggcatggacgaggagatccgcaagcgggccctggagccgttcttcaccacccggccgaccgcggccgggctgggcctggccaccaccgcggggatcgtgcagaacctgggcgggcacatcgagctggagtcgaagccgcggatgggcaccacggtgcacatctatctgccggccgccgaggagcgggcgcagccggccggtgagcgccgggagaagtccgcggtgatcggccgggtgctgatcgtcgaggatcagccggacgtggcgcagctggtgcagcggctgatcgcgccggccggctacgagatcgcggtggccaccgacgcgctgaccgcggtcacccaggtggcctccggcgcccggccggacctgctgatcaccgatgtggtgatgccgacgatgaccgggccggagctggccggggcattgcgcacccaccaaccggatcttccggtgctctacatgtccgggtacaccgcggcgtcgctggggccgcagttgcacctggacgacaacagcatgttgctggagaagccgttcacccgttcgaccctgttgggggcgatccggtcgctgtgcggcccgcagccgacgccctgaacgacttctgcgggtattcgtgacggtccggtggacaagcctgccggaccgtgcgaacttgccgccgcgggcttgccaggccatccggacaaaaagcaatattctccatcatgcaggattcgaccgacagcgagccactggccggacggagtgtcggcaattcgtaccggctcgtcaagccgatcgggcagggcgccaccggaacggtgtgggagggcgaggacagcaccaccggggaaccggtcgccgtcaaactcctgcacgagagcctgctccggcagccccggctggtcacccgcttcgtccaggaacgcaccatcctgctcatgctccgacaccgcaacgtggtccgggtccgcgacctgttcagcgtcggcgagaccctcggcctggtgatggacctggtggccggcggcagcctgcgcgaccacctgcaccgcgaacgcaccctggcgccggccgaggcggtgcggctcgccgcgcaggtcgccgacgccctcgccgaggcgcacgacctcgggatcatccaccgcgacctcaaaccggacaacatcctggtgctcgaacgcaacggccggctggagacccggctgaccgacttcggcatcgcccggatcctcaacgtgccgagcatgaccaccccgaacgcggtcgtcgggaccccgcactacatggcgccggaggcgttccacggggtcacccccagcccggccaccgacgtctacgcgctcggcgtgctcctctacgagctggtctccgggcagccgccgtacctcagcgactccgtcccggaactgatgcgcatgcatgccgagggtcgtccgaaacgtcgccccggcatccccgacgacctgtggagactcatccgcggatgcctctcggcgaagccccggcagcgtccggcggccgccgctctcgtgcgtgagctgcgcgaactcaaccgcaaactggccggaatcgcgccgctgccgccgcccgcgccgcccagcctgccgcccgccgacccggacgaccgggcggtcgacccgccggaactgcgcgacggcatccggctgccgcgctagctagctagcggggtgctgctcgccgccggcgtcgccggctcgatctggcggcacggcggcaccccggcctcgccgtcggcgctgcccagccaccccgcgccggccgcctcggtccaggtcgtcccgcgccgaaaggtcgtttcctccacgaaacctgcgaaaccttcccgcgtacgtacgaaacgggccgtccagccgcgcccaccccagccggaggacgaggtgcggggcccgtgggagtgcgcgcccggcctcatgatcgacctggccacccgcagtccgctcgccccgaagccgtgccagtcgatcggccggaccgtgcagttccaggcgtccctcaccgcgccggccggcggccgcgcgcacatcgaggtgacgttgcgcgacgcggacaccggtcgtaccgtggccggccccaccacctgtgacgggctcaccttcaccggcggtcagatgacccgggcctgcggaccggccggcgccacaccgcgccgcggccgcaactacaccgtggtgatggccttccggtacgagcgggacggccacaccgcgaccagcaccgcccggggccgggtcttcacctggtgacaggggttactaagatccttcgatacccgcggaggtggtgtccgtcatgagcttcgatctgtacgtctggcacgagccggaaccgatcacgcccgcgatcgccgagagccggctgcggcagggcgccttccgcccgcatcccgcggtccgcgccatgcgcgccgccctgctcgaccgcttcccacccggctccggcacgtggagcatcgtcccgccggcctccgacgaactcctggccctgtcggtcgcctggccccgggccggcgaggtgggcgccgccgtcgtcgcactggcccgcgagcacggcctggtctgctacgagccgcagagcggcctgctcaaccccaacgccgccgggcacctcgccgccttcaccctcacctcggcggccgggccggagatccccgaccccagttccgaccggatcgacaccctggtcggcgagctcggtccggacaaccacttcgtcatcctggaacgctccgacgggtggttcgtgcaggtgggttacgggccggcggccgggaccgagccgggacggtatgcgctggaatatcgggagggcgggccggagcatcacttccggaccgagacgaccgatccgctggaggcgtcgcggttgctgaccggattcctgaccggcgacgattcgtggaagcgccggtatgtctggcggccgctcttctcctagccttcgcggattgcgccggttcctctgaccttcccggattgcggcggcgttttcagccttcccggaccgtggcggcggtctcggccttcccggattgcggcggcgttttcagccttcccggattgcggcggccagtagccggatgaattccgggtcgtcctccgggccgatcggcttttcgccgcggccggcgctttcgtggccggcgaggccttcgccctggccggcgttctgacggcggccggcgcggaaccaggcgatggcgccggcgaccgggcagcagaggatcagcacgagccaggcggcgcgcgggaagtgccggagccgggcgggggcggtgagcaggcagtcgatcagcgccaccacgacgagcgcgacggcgagcaggaagagcagcgtgttcactcgggccatgcccagggatcctgccgtccccgggcggtcatcggaggtccccgcccggtgccaccgggttgcggcggggcacgcaggccccaccgcgcaccgcggcggtcaggcggcgttcgtcagagccgggagatagccgtacgtgtagccgttggtgttggggtggtaggagttctgcggcgggatgatggtcaggccgttgaggtacggcctagacgcgcacaccccgtggccggtgaagttgccgcggacgtcggcgaaggtgaagcccgcggcggtcgcccgcgccttgatcatgtcgtccagggcctgcgccccgctgttcagcgccttgcgcttggtggcgtccatctcgcagagcgccgacgaggtgtcgaagatgttcgggtaggacagcacgaccaccttcgcgcccggggccttcgcacggatcgcctgataggtcgcgtcgagcttgccgggcagcgtgttcgcgacgtacgtcttgccggccgcgaccttcgcggcgcaggtggcgtcgctgctggtcaggcaggtcagcacggtcggcgcgaagccggcgtcgttgccgccgatggtgatgctgaccaggtcggcgccgctggtcatggccgggacctgggtgttcagcacgtcgtcggtgaccgcaccgctgcaggccaggaactggaacgaggccgggctgtgcttcgccgcccactgtgcggcgtagctgtagttgctgcgcaggcagctgccggattgtccgggcgcgccgaccccggacgagtaggagtcgccgagggcgacgtagtcgacgccggccgcttgggcgggggaggcggcggcgatcgtgagcgcgaggacggacgaggagacgagacaggcgaggacggtagccctactcatcgttggcctccgatatccacgaggggatctctggggccgaagcgcttcggttaccgcacagtaagtcaagagcccgagaaatagaaagcagtgattttcctgttacagaggagtaacatacatcgatgtgacctgggggtatgtccctgggtgatgttacatgaccggatggtgacgggctttcggcggctgcccagccggccttcagcgtgcctccagaaagtcgggctacggtcgggcgcatggacgagaaccgggcccgccgagtggtcgctcggctgcgcgagcgcaatgtcttcgctcatctgaaacttccgcacgccggtctcacgcagtacggcatccggatcgtgctgccggacggccgcgaggcgatctgggacaacgacggcaccgcgggcctggaggcccaggtgatgcgcgacggcgtgctggtcggcttcgtcgcgtcgatcccgggctccgagcggttcaccgacgagcagatcatcgacgccgtcgcgaccgcggactacgaccgcccgatcggccggtccgcgccggtcgccggacgccggccgaccccggcgccggccccgccgtccctggcgcaacgcttccgctccacgttcgggtagggatagccctaccccgaagtccagggtctgccgtgttatgccggagagccgtttcgaccaggctcgaggcatgcggaacacacccgtcgtcgagctgatcgacgtcaccaggagctacctcggcgtgcgcgccctggccggcgtctcggccaccttcaccagcggcaccttcaccgcggtgatgggcccgtccggctccggcaagtcgaccctcctgcactgcgccgccgggctcgaccggcccggcaccgggcgggtgctgctcggtggacaggacatcggcgacctgcgcgagccgaaactcaccgaggcgcgccgccgggtcgccgggttcgtcttccagtcctacaacctgctcgactcgctgacggtctggcacaacgtgctgctgccgcagcgtctggccggcgtccgcgccgaccacggctgggcccgcgaggtgctgcgccgggtcgggctcggcggtcgcgagcaggctcggccggcccagctctccggggggcagcggcagcgggtggcgctggcccgggccctcgccgcccggccgcaggtgatcttcgccgacgagccgaccggcgcactcgacctggccgccgggcgcgacgtgctgggtctgctgcgcgaggcggtcgacgacctcggcacgacgatcgtgatggtcacccacgacccggccgcggccgcacacgccgaccgggtggtcttcctggccgacggcgtgatcgtgggcgcgatggacgcgccctccgcggaccgggtcgcggcccggatgaccgaggtcagcgccgccgagggggtggcccgatgatccggctggtgctggggtcgctgcggcagcaccgcggggcctacgcgggcacgctcctcgccgcgctgctggccgtcgcgctgctcggcggcggcgggctgctgctcttctcggtgctgaccgcgaagccgccggccgaccggttcgccgcggtgccggtggtggtcgccggcgcccgggaggtgagcctggagacggtcaccaccaaggcgaagaaggagggcaagaccaaggtcaagcacaaggtcaagaccgagcggctgaccggcgccgcgccactgccggccgacctggccgggcgggtcgcggcctagctagctaggctccggcggccgggcaggtggtgctcgacgccgggctgggccgccgcgggtgccggtcggcgccgagctgcggatcaccacccgcaccgggacccggacgctgctggtcagcggcatcgcggcgccgccggggcgggacgcgctgcccgcacagggcgcggtgttcgtggccgacagcgaggtcgcggcgatctccgggctgaccgggcccaccgcgatcggcgtccgcccggcggccggtctggacccgtcggtgctccgcgaccggatcaccgcggcggtcggtgttcccgcgacctccggcacctccccggcgcccgcctcctccaccgccgctgtcccggcgtgggccttgccggccgcggcttcctccaccgcggctgtcccggtcggggccttgccggccgcggcgtcctccaccgcggctgttccgtccggagtcctgccggcctcggctccggcctcgggggcgtccggtggggccggtgcgatcgtggtgttgaccggtgacgaccgggtccgggctgatctgcccggggcgttgcccgactacatcgcgccgatctcgatcttcgggttcgtcatcggcatcaccgctttcgccgcgatcttcgtgctcaccggcacggtcacgctgagcgtccggcagcggctgcgcgagctcgccctgctgcgcaccgccggcgccacgcccggtcagctccgccggatgctcggccgggaggcgatcgtgctcgccctgatcgccgggctgcccggcgcgccgctcggcgtggtcctcgcccacctggtggcggcccggttccgggctctcggcgcggtgcccgccccgttcgtcgtccgggtcagtgtcccggtcctgctgctcgcaatcctcgccgggacgctggtcacctacgtcgcggcccgcctcgccgggcgccgcgcggtgcggatcgcaccgacccaggcgctgaccgagaccgcgaccgcacccaccggcggccgggccgtgcgggtcctcgccgctgtcgtcaccacggccggcgccgtcgcggtgctgagcttcgtccccctcgacggcccgttcgggatgggcatgagcttcatctccagcgcgctgctgctctgcgccgtcgccgccctcggcccgatcctcgtccggccgctgaccgccctgctcggccgggtgtccgggttggccggccgggtgtccggcttggccggcctgatcagccgcgccgagtaccggcgcgtcgccgcggtcgccgtcccgctcgtgctgatgttcgcgctcaacgcgaccatgctgctcaacggcagactgcaggaccggctcgccggcgtgcagcaacgggaacgcctggccggcgcgaccgcccaggtcgcggtgccgggcgggttggccctgcccgacgccgagcggatcgccgcccggcccggcgtgaccggtgcggcgctgctactgcccacccgggtgatcctcgcccagggtgggaagccggaggactacgcggcgcagggactgatgaccaccggcgccgacccggcgatcgacctgggcatccgggcgggggcgccgggggacggtctgggggcgagtgcggcggtggcccgacagtacggctggcggatcggggaaccggtcgacctgtggctcgccgacgggtatcgggtgacactgccgctggctatgacgtacgcccgcaatcgtggttttggagatcttgtcctgcccgccgcgctgatcgcggcccacgacccgaagggcctggtcagcgtgatcagtctgcgcggagcgccgggtgtcgcgcggggcctgccgacgatctccgcggcgaccgccggcggtgaccacgccgatcagcagggcgcgtgggagttgatggtggtgatttcggtgggcttcaccgcgatcgccgtggtcaacacgttcgcgatcgccaccgccgggcggcgcggtgaattcgccgcgctgcggctgaccggggccaccgcgggccagttgcatcggctggcggccggcgaagcggtcgtcaccgtgctgaccgggctgctgctcggagctaccgtgagcggcatcgtggtgggcgcgttcagcctcgcccaggacggtgcgctccgggtgatcgtggacccggtgacgtacgccgggatggccgccggggtcgccgcgctcggcctcgccgccggcgtcctcccggcccgtctgctgctgcgccggcgtgcaccggccatttaggatgccggcgatgatcaagcgaaccgggcgggcgctgggctacctgatcaccggaccggtcgcgggactcgccggattcgtctggagcacggtcgccggactgctggtgaccgtgctggcggtcacccagctgcgggacccggcattcctgggcgccgcctgggtgacccggcacctcgcccgggccgaacgacggcgggccggctgggtgctgggggcccggatccccgacccgtacctggcgggcacgcccgtggtcgcccagccggccacctggcgtgacctcgcctggctggtgctgctcctgccgatcggcgtggccaccggggtggccggggtggtcacggcggccgtcgacgccgccgcgatcctggcaccggcggtgttctgggcggtgccgaatccgcacgcgccgttcccgatgcggccactgctcaccacggtgccggggcggatcgggctgaccgtgctcgggctggcgctgctgcccgtcgcggcccggctcgtccgggccctcgcggccgggccggcccggctggcggcggtgctgctcggaccgggcgaacacgggcggctggtggcccgcgccgaacggctcgccgaaacccggcgccgggtggtggacgcgcaagccgccgaacttcggcggatcgaacgggacctgcacgacggggcccaggcgcggatcgtggccgccgggatgacactcgccctggccgcccgcaaactccgcgccgccgcgcccccggcgtcgggccggcccgacggtggcggcgacccccggaccgacgtcgagctggcgcggcggcagctcgacgatgccctggccgagctgcgacggctggtccggggcatccacccaccgatcctcaccgaccggggattgcacgccgcgctggccgcactggccggggacagcccgttcccggtcgcactgcacggggacgcggccgcgcgctatccggccgcggtggaatcggcggcctacttcgtggtggccgaagggctcaccaacgcggccaaacacgccggggcggccagcggggagatcgacctgggcagagtgggtggggtgctccgggtgacggtgaccgacgacggtcgcggtggggccgacccggccggagcggggttggtggggctgcgccgccgggtcgaggcgctcgatggcacgctgacggttaccagtccgcctggtggcccgaccaggttggtcgcggagttgccgtggtcctcgtgaaagcggatgggcaccgatggcatcgaccgcagcgagcaccgaccgcaccgaaagcacctagcgcatcgacggcatcgacggcatcgatggcatcgcctgcaccgagcgcatcgaccgcatcgacgggatcgccggtgtcgcggggggaggggaagcgctgtgcgcatcgtgatcgctgaggatctgctgcttctgcgcgaaggcatggttcggctgctgaccgagaccgggcatgaggtggtcgcggcggtcggggatgcgatcgggctgctggcggccgtcgacgagcatcggccggacctgtccgtgatcgacgtgcggctgccacccggattccgggacgaagggctacgggcggcattgcggatccgggccgcggatccgggcgcacgggtgttgatcgtttcgcagtatgtcgagcgggcctacgccgctgagctgctcgccgacggacgtggcggggtgggatacctgctgaaggaccgggtgacggcgctcgacgacttcctcgacgcggtcgaacgggtggccgggggtggcacggcgatggacccggaggtggtgcggcagctgttcgcacgcggcggcggcaaccatggcatcgacgggctgaccgcccgggaacgcgaggtgctcgccctgatggctcagggcctgtcgaacgcggcgatctgcgagacgctggtgctggccccggtctcggtggagaaacacatcaccaacatcttcggcaaactcgacctgccgccggcggctgacgctcatcgccgggtccgcgcggtgctcacctacttcaatgccgccacctgacccggcgggcagggccgtcccggaggccgtgcgcccggcatgatctcggcgagcggcgagcggcgagcggcgagcggcgagcggctagctagctagttggtggcgcagggaccgcgggccggggcgctgcggacggtggtgtgacggctggggtggggtcaggcggagtcgcgccagatgatgggggtggggagtagctgggcggggacgttgatctcctcgcctcgcagctggcggaggatgaggtgggcggcagcggcgccgagctccttggcgggctggtggaccgtggagagctggggctgggtgcggaccgcccatgtgctgtcgtcgaagccgacgatgccgacatccgtggggacggtgcggccggcctcgcgcagggtttccagggcgccggcggcgatcgcgtccgaggcggcgaagacgccgtcgatggtggggtcgcgctccagcagcagacgcattcccttgacgccggaaccgtaatcgtagtgcgggacctcggcgaccaggtccgggttgaacgcggggccgagcgcggtgcggaaaccggtcaggcggtccatgccggagtcgcggtcgacggcggcggcgatcatgccgatccggcggcggccggtggccagcagccgggtggtgatctcgcgggccgagccttgattgtctattccgacgtagggcgtgctgtggtcgagatcgggcgggtggccgacgaacgcggcgggcaggcgcaggtcgcccaggacctggatgatcgggtcgtgggcgcgggccgagacgacgatcgcgccgtcgacgaagccgccgctcaggtatttcgcgacccgctccatgtcgcgggtggactcgacgaccaggctgaccatctggtggtcggccagggacagggcggcgttcgcgcccagcatcagcgcgccgatgttcgggtcgtcgaggaacagtgagtgcggctccagcgcgacgaacgcgaccgcttcggaacggcgcatcttcagcgcgcgggccgcggtgttcggcacataaccgacctcggtgatcgccgcctcgatcgccgcgcgggcctcggcggagacataaccgccgttcagaacgcggctgacagtgccccgggacacgcccgcggcggccgcgatgtcgtgcaccgtggcgcgtttcaagggcggcggcatgcgctcaaagatacgcgacgtgagattcccggaaccgggacgtgcggtcagcggcggcgtgacctggggtggcgggccggcggcgggaagtcggcggcgttgtgacttgcggggccggcgatggtggtgggctggtggccgtggccgtggccgtggccgtggcctggggtggcgggccgggcggcgggaagtcggcggcgctgtgactcgcggggcgggccgtggtggtgggccggtggccgtggcccggatggcgggccaggggacgaatgctcggcgggggcggggccgcgggtggcacgttggcggggcgcgaggtcgtgaacagggaagcggccgggaaggcagggcgagagagaccggcgatcaaagatgccgctgtggccattgacctggcgtcggacgtcgtcttagtgtgtgcacgttcacacatccgtaacgccgatgtcggcgcagggaaatgtgtgcacgtgcacacatcggtgaccaggagtttcatgaaaagcatcgtgctgggttgtgactacaatccggagcagtggacccccgaggtctggcgggaggacgtcgcgctgatgcgcgaggccggcgtcaagctggtggcggtcaacatcttcggctggtcgcacctcgagccgtccccgggccgctacgagttcgacgccctggacgaggtcatcggcctgctgcacgccggcgggatcaggctgaacctgggcaccggcaccgcctccccgccgccgtggctgaccaccctgcacccggaggcgctgccggtcgcggccgacggcaccacccgcttcccgggtggccgacaggcgtggtgccccagctccccggccttccgggagcgggcgttcgccctggtcgagcaggtcgccgaccgctacggcgaccacccggcgctggacctctggcacgtctcgaacgagctgggctgccacaacgcgctctgctactgcgaggccagcgctgcggcgttccggtcctggctgcggcgccggtacggcaggatcgaaaccctgaacgacgcatggggcaccgccttctggagtcagcggtacggcgactgggccgagatccagccgccccgcctggccctgtcggtccgcaacccggcgcagatcgtcgacttccaccggttcagctccgacgagctgctcgactactaccggagtgaggcggccatcctgcgggcccgctcggccgccccggtcacgacgaacttcatggtcaccgcgcacatccgcaacctggactactggtcctgggcgccggagatggacgtggtggccaacgaccactacctggatcaccggctgggtgatccgacggccgagttgtccttcgccgccgatctgacccgtgggctggccggcgggaagccgtggatgctgatggagcaggcggccggcgcggtcaactggcagccacacaacctgaccaaggcgccgggcgagatgctgcggaacacgctgacccatgtggcgcggggcgccgactcggtctgcttcttccagtggcgggcttccgcgcagggtgccgagaagttccattcggcgctgctgccgcacgccggcacggacaccgtggcgtggcgcgaggtgctgcggctctccgacacgctgggccggctgggtgaggtggccggcacgaccgtgcgagcggacgtcgcgctgctgttcagctgggattcgtggtgggcggcggagggggaggcccggccgtcgcaggcggtggagtatctggaccaggtgcacgcggcgcaccgggcgctgcgcgacctcggggtcacctgtgacgtggtggcgcccggggcggagctcacgtcgtacaaagtcgtcgttgttccctgcctctacatggtcgacgatctggcggcggtgcggatcgccgatttcgtcgcggccggcgggaagctgctggtgacgttcttcagcggcatcgtcgatgagcgtgaccggattcggctgggcggctacccgggtgcgttccgcgatgtgctgggtgtgcgggtggaggagttcgcgccgctcaagcccggtgacgaggtgcggctcagcaacggcgcgacggcgacgctctggaccgagcggctgcgggtcacgaccgcggagccggtcgccagttacctggacgggccgctgctgggggttccggcggtcacccgcaacgccttcggcgcggggacggcctggtatgccgcgacagcgctcgacgccggcgcgctgcgggacctgctgcgcgagatcaccggggtgacggcggagaagccgaagaacaccgaggtggtacgccgcggccactacctcttcgtgatcaaccacggcgccgagccgatcgagtacccggtgaccggattcgatctcgtcaccgagaaggcgaccgacgggctgctgcgggtcgagggcggcggcgtcgcggtggtccgggaggaatcatgatcaagaagagagcgatcgccttcttcgtgctgccgttcggcgtgctgttcgtcgcgttctacctcgcgccgatcggtttcgccgtcaagcagtcgctctatcgcgtcacccgcaccggcacgttcggcccggcgcacgaggtgttcggcggcctgacccagtatcagcgcgtcttcgagaacgcgccgttctggcagtcggtcggccgggtcctgctcttcggcgtggtgcaggtgccggtgatgctcggcctcgcgctgctgctcgccctgctgctcgactccggtctggtccgggggcgccgcttcttccggctggccttcttcgtcccgtacgcggtgcccggcgtggtcgccgcgatcatgtggggcttcctctactcgccgaacctgtcgccgttcaccgcggtgacccgggcctgggatctgctctccgccgacctggtgctgtgggccatggcgaacgtggtgacctgggtctacgtcggctacaacatgctgatcatctactccgccctgctggccatcccgcaggaggtgtacgaggcggccaccatcgacggcgccggtccctggcgcaccgcgtggtcgatcaagattccactggtgatgccggcgatcgtgctgaccacggtgttctcgatcatcggcacgctgcagttgctggccgagccgcaggtgttccgcaccttcagttccgcggtgtccagcacgtacaccccgaacctgaccgtctattcgacgtcgtcgatcccgaacttcaacctggccgccgccttcagcgtggtgctggcgctggccaccttcgtcctctccttcacgttcctgaaattcacgcagcgagggggcgagaagtgaagtcgaagaccgcggccatggccgtgatgggcatctgcaccttctatttcctggtgccgatctggtggctgttcgtcggcgccaccaagtcccgtggcgatttctcgaacacggcgcccctctggttcgccgacttccacctcgggcagaacctgcgggaactgttcgcgtaccgcgacggggtcttcctgcgctggatggcgaacagcctcgcgtacaccggcggggccgccctgctcggcacgctgctcgccgcgatgtgcggatacgccctggccaagtaccggttccgcggccgggagctgatcttcaacatcgtcctcggcggtgtcctggtgccggccaccgcgctggccctgccgctcttcctgatcttcagcaagctggaggcgaccaacaccttctggtcggtcttcctgcccagcctggtcaacccgttcggggtctacctggcccggatctacgccaccgcgagtgttccggaagaactgctggaggccgcccggctggacggctcgggcgaggtgcgcaccttcttcaccgtctccagcaaattgatgtttcccgctctggtcaccatcttcctgttccatttcgtggcggtctggaacaacttcctgctgccgctgatcatgctcggcaacgagcggctgttcccggtgactctcggcctctactcctggaacacccaggtcaatcagcttcctgagctgcggatgctggtgctcaccggcgccctggtctcgatcgtccccctggtcgtcgcattcctgctgctccagcgcttctggcggagcggtctcggcagcggcgcggtcaagtaatccctcccggtaaaaggtggatagaaaaatgaagaaactgctttccggtctgttgatctcctcgttggccctcacggcctgttcctcgaagtccggcgacgatgccgccgcgaccaccggggcggccggttgcgccccgtccagcggcccggtcagcctgaccttcacctcgtggatcccgaagatcgaggaggtcgtcaaggtctggaacgacaagcacccggacatccaggtcaaggtgcagaccggcccgaacggcaacggcggcacgtaccagaacttcttcaaccagctcaaggccggcaacgcacccgacctggggcagatcgagtacgacgcgctgcccagcttccgggtccaggacggcctcaccaacgtggccgcctgcaagccggtcagtgacgccaaggaccggttcatcgactggacctggaaccaggtgagcttcggcgagaaggacgcggcgtacggcgtgccgcaggacgccggcccgatggcgctgttctaccgcaaggacctgttcgcgaaggccggcatcccggtgccgaccacctgggaggagtacgccgcggcggccgccaaggtgaaggcggccggcggctacatcaccaacttctcgcagagcgacatcaaccagttcgccgggctggcctggcaggccggcggccactggttcgccaacgacggcagcaagtggaccgtgaacctgcaggacgaagcgaccaccaaggtcgcgaattactggcaggatctgatcagcaagaagctggtctccacggtgccgccgtggaccacggagtgggacaacgcctacaacaagggtcaggcgtggacctgggtctccgcggtctggggcgccaactcgatctcctcgggcgcgccggacaccagcggcaagtgggcggtcgcgccgatgccgcagtggaccgcgggcggcaaggtcgccggcaactggggcggctcgtcgacggcggtcttcaagggctcgaagcacccgtacgaggcggccgagttcgcgatctggctgaacacctcggaggaggcgttgaccctgctcaacgagaaggcgaacctctacccggcgaccaaggccggcgcggcgctcccggcgctggccaagggcgtcgacttctacggcggccagaagatctacgacgtgttcgcgcaggcctccacccaggtcaccccggacttcacctgggggccgacgatgacctcgacctacgccaccgcctcggacggcttcaaggcggcggtctccggcagcggcaccctgctggacgcgctgaagaaggcgcagacgtcgacggtcgacaatctcaagtcgcagagcatcccggtcgccgagtgaccttcacgcatctgcgggccgcgggcgtcagcttcgtgctgaacgcccgcggtgcggtgctgtactggggcgccgatctcggcgaactgccggacggattcgccgccagtcgcattccggcgatcccgcccagctccatcgacgtaccgctgcaattgtcattgctgccgtcgatcgaggacggctggaccggccgccccgctttccccggccatcggacccggatcactgccgttcagcacggtcagaacacgattacggtacgcgcagagcaagccggcaaaggcctggagctgacgaccgagtgcgagttgactcccgagggcgtgctccgcctgcgccaccgggtcgacaatcacggcctcgccgttgtcgacctggccgccctgaacgtgctgctgccgattcccccggaggccaccgagctgatcgatttcagcggcctgtgggcgcacgaacgccgcccgcagcgcgccccgctgcgcgacggcgtctggagccgggagagccgccacggccgccccggccacgacgacgcgttcctgctgatggcagccactccgggtgccggcttccggaccggccgggtgtgggcggtgcacctggcgtggagcggcgacaagcagatctgggcggaacgttcgcccctcggccagtccgtgctgggcgccggtgaattgctgtcacccggcgagatccggctggccccgggcgattcgtacaccaccccgtggctgatcgcggtctattccgagaacggcttcgacggcctttccgaccggctgcacccgtggatccgcgcctcccggagaaccgcgaagccccgcccggtcgtgctgaacacctgggaggcggtctacttcgaccagtcgctcgaccggctgaccgctctggtcgacgccgcggcggaatccggcgtcgaacgattcgtgctcgacgacggctggttcaccggccgtcgcgacgaccgccgggccctcggcgactggcacgtcgacccggtgatctggccggacgggctgcacccgctgatcgcccgggtcgaggccgccggaatggatttcggcctctgggtggaaccggagatggtcagcccggattcggtactggcccgcgcccacccggaatggattctcggcccgccggacgcgctcacctggcgattccagcgggtgctcgatctggccgtcccggccgcctacgcccacgtgctgggccgcctgaccgacctgctcaccgagtacccgatcgccttcctcaagtgggatcacaaccgtgacctgctcgaacccggtgccgcgcaccggcagaccaccgcgttgtaccggctgcttgccgagctgcgggcggccttcccggagctggagatcgagagctgcgcctccggcggggcccggatcgacctcggcatcctgccgcacgtcgaccggttctggacatcggacaccaacgatccgctggaccggcaactgatccagcgctggacgagcgtgctgatcccgcccgagatgctcggcgggcatctcggtgacggcgtcgcgcacgtcaccggtcgtacctccgcgctgggcctgcggatggcgaccgccctgttcgggcacgccggcatcgagtgggacctctcccgggcggccccggcggaccgggcactgatcgccgcctggaccgccgagtacaaacggctgcgcggcctgctgcacaccggcgtggtggtccgcgccgaccatcccgacccggcggtcctgctgcacggggtggtcgccccggaccgctcggccgcggttttcgccctggtcacgctgggcaacccggtcgccgcgctgccgccgccgatccggttccccgggctcgacccggaccgctcctacacggtgcggccgctgggccacccgccgcggatggtgcaggacgccccgccgccgtggctggccgaaggcgccgtcaccctgaccggccgggtgctcgccgaggccggcctgcccgccccgctgctggttccggaacaggcggccctgttcacgctgacggccgtcgcctgacccgcttctgtcgtgcatacgacagacgcgggcggtgaccggtcaccgcccgcgacgatgtcactccatcgtggacttcggagggcatcgggatggttcggcgctggattccgttcgccgtggcggggctgctcgtcaccaccgtgccgggcactccggccgcggccgcgactccggcgacgcggtacgtcgtgcggctcaccggttccgccacagccgaccgggtcgcccggtccgccggcggcaaggtccaccaccgcttcagcgcggcgctgcacggcttctccgccgacctcaccccggcggcggtggccaggctgcgccgcgacccgtcggtcgccgcggtcgacccggtgcgcccggtgcacctcgccgacacccagaccgggccggactggggtctcgaccgggtcgaccagcgcgcgctgccgctcgacggcaagtacacctggaccggcggcggggccggtgtcaccgtgtacgtggtcgacaccggcgtgatgaccacgcacaccgagttcggcggccgcgccaccgcgccgatcagcacggtcggcgacccgttcggcaccaccgactgccacggccacggcacgcacgtggccggcacggtcggtggcgccacgtacggcgtcgccaagaaggtgaagatcgtcggtgtccgggtcctcgactgccagggcaacggcaccgacgagggggtggcggccggcctcgactgggtcatccagaaccacgtcagcggtccggccgtggtcaacctgagcctcggcggcgacccgtccgcggtgatggagaccgcggtgaacaacaccatcgccgacggcatcaccgtggtcgccgcggccggcaacgacagcaccgacgcgtgccagcacagcccggcccgggtgcccgcggtgatcaccgtcggcgccaccgccaaggacgactcgctggccggctactccaaccgcggcccgtgcgtcgacctgctcgcccccggtgacgacatcacctccgccgccacctggtccaccaccggcagcaccgagatgtccggcacctcgatggccagcccgcacgtggccggcgccgccgctctgctgctcggccgcgagcccaccctcagcccggccgtggtcgccgcccggctcggctccgcggccacccccaacgtggtcaccgggctcaccgccgccacgccgaacctgctgctcagcacgctgaccacggtgttgccgctggccaccccggcgacccgccggctggccgacccgctgaccggccgggcctactcggccgggctgcaggccaccggcggtgtcgcgccgtacacgtggagcacggtcagtggcacgctgcccgccgggctgacgctgagcgcggccggacaggtcaccggcaccccgagcgccgcggcggcggccaccacggtcaccgtccgggtcaaggacaccggcggccgcaccgccgactcgaagatcaccctcgcggtgaaggcgcccggcctcccggcgatcggcgagttcgtgcccgcggtgcgcaccgccggcggcggccagtccttcagcgacgccggcggggtgtcgctgagcgccgacggtcgctacgccgcgttcgtctccaccgcgggcgacctggtcaccggcgacaccaacggggtcgccgacgtgttcgtcaccgacctgaccaccgccaccaccaccctggtcagccggaccaccaccggggcgatcgcggacgccgagagctgggagccggacatctccgccgacggccggtggatcgccttcacctccacggcgcagctctcgccggacgacaccaacgaggcccaggacgtctacctcgccgaccggaccaccggcgccgtcaggctggtcagccgcccgcccggcaagcccgcggccggcggctcccacgcgccgtcggtcaaccaggacggcaccagggtggcgtacctgtcgagcgaaccggtcctgtggggcggcaccgacccggcggtcatcgaccaggcgctggtcgcgacgatcgccaccggggcgcagacggtggtcagcgtgaccacggccggcaagccgcccaccgacggcaacagctatcacccggtgatctccgcggacggccgctacgtcgcgttcggctcggcggccgccgcgatcagcagcgccacgccggccggcaacttcgccgaccacgcgtaccgccgcgacctgaccgccaagaccacgaagatggtgtccgcgcacgccgacggcaccgccgacagctggggcgagctgctcgacatgtccgccgacggacggtacgtgctggtcacctcgatggatgagctggccggggacgtgggcgcggtctacacccaggcctactggcgcgacctgacggccggcacgatcaaggtcgccagccgggacccgggcgccgcctacaccgccgaccaggtgcagggcggccggctctcggacgacggcagccaggcgacggtgacggtcgagcacaccgactcggccgacccggcggcggccaggtccagcgtcctcgcggtcacgccgtcgaccggcgcgtcccgccggatcggtccgtggtacctgccgatgccgccggattacgccgggacacggcgggtgagtgacgatgcggtgctctccagggacggcacctatctgctcgcggccaccaccaacgcctcctcggtgccgggctacttcgccggcccgctgaccccggccgtcacccgactccgctgagcccacgccgcagcccgggtcctgcccggggccgagccggaagcggtcgatcggaaagtccaccgagtacaaccagcccgcgttcggggacgcggcgaacacccagacgtacggcagttgcaacgaggagctgccccagtaccgcaggtgcaggctgaaggtgacccggtagtggcctttcgccaggggtggcggcgtccacggcgggcccgtggatgtcgccaggacgggggtcactcccaccaaggcgggcggcgcttgctcgtgggagtcgggcgaaccaccatggatcgggatgatcgcggttgtacccgggccggtgaccaggatgagccccacgtcgtggcggagaacggtgcgccggcggggtgagccggatgggcggccggggccgggtcggctgagtgtcgatgcacgagctggcgaagggccggtcgctcggaggtgacgtagcaagccggctgtcgcgacggcggggtggagcgggaggttgaacggcaggctcagccgccgaagcgttcggtgcggaccttcttcgggtcgtgtccgagcgccaccaggatgtcggcgaccgtctccacgaacgcggtcggcccgcagacgaacacgtccggcgcgaagtcgggcggccaaccgtacgtgttgaccgtcgccacgtcgatccgcctgttcggccccggcccggagcgggtgtgcacgaagtggacgtccagcccggggtcgtcgcgcacgcgccgccgcaactcatcggcgtagtacccgtccgccggcgtgcgcaccgagtagatcagccggaacggctgccggccgcgccgccgcccccggtcccggatcatcgccatcagcggcacgatccccgacccgccggccaccagcagcaccggggcgggctgcgcggaccgccagacgaaccagccgccgatcggcccgcgcacctcgatctggtcgccggcctcgacgacgtcggtcagatagggcgagacctcgccgtcctccagccgctgcacggtcacctcgaccgggccctcgccgggccagtccgaggcgatcgaatagcttcgctgcgcggagtagccgtcctcggcggtcagcttgacgtcgaggtgctggccgggcaggtggccgggccagccggggatgtccaggaccagggtgcgggccgtcgcggtctccgcgcggaccgcggagaccgtggccacctgccaggtcagtcgccctggtagcgctgttcgtgccacgggtctccgtacatgtggtaaccggcgagttcccagaatccgggctcgtcctcgtgcatcatctccaggccgttgacccacttggccgacttccagaagtacaggtgcgggatgagcagccgggccgggccgccgtgctcctcctccagcggctcgccgtcgaactcgtacgcgatccaggcctgcccgtcgagcagatccgccagcggcacgttggtggtgtacccgccgaagctgtgcgccatcacgtagtccgcggcggtctccacgtcctcgaagagcgtgtccagcgagacgcccttccacgtggtgccgagcttggaccacttggtgacacagtggatgtcccgggtgatctcctcggccggcagggcggtgaactccgcccagttccaccggtgcttctcaccggtctcggtgctgatggtgaaactccaccggtccgtgtcgacgcgcggcgtcggaccggtggagagcaccgggaagtcgtgtgtcagatattgaccgggcggcaggtccggcgcggagtcacgccgccgcccgccgaagccccgggagatgatgcccatgggatatgagtaaaccccatcggcgatcaggccttcactgtcttgctggtgacaccggacaccttgctggtcgaggccagcaccgcccggtagctgccgccgctgaccaggccggtcactctgcggctgccggtcgcaccgaaggtcttgacggtcgtccagcgcttcccggcggatcgctgcaggctcagtttctgaccgccggcgccggagacgcggatcgtcagggtccgcttggcggtgcgggtcaaggacaccaccccgattgcggtgtacgtcgtgaccgccgacgccgagcccgccgtcagccgcgcacggaacgaggcggtcgccgtgcgggtcagcgtgaaggtgccggccgcactggtgcgcaccgagtcacacgcccacgagccgccggcgaccgagatgcagatcgaggcgggctggtccgcccagtcggacacccggaacgtggtgctggtccggctgccgtaggtgaccgacctacggctgacactcgcggacaccaccggcggcgtgctctgcggcgtgctcaccggggtactccccggggtggcatcgacagcggtcagcgccgcggcggcgtccacccgcccgtacccgtaatcgtcgtccctgccggcggtgccgaggtcggcggcggatgtctccagcgcggtctgcacctgatccggggtcagccccggcttcgcggcgagcagcagcgccgcgaccgccgcgacgtgcggcgtcgccatcgacgtgccgctcatcgaggcgtatccgctggcgcccagcgcggtcggataggtgctcaggatcgcgctgccgggcgcggccacgtcgacgtagccgccggcgttggagtaggcggcgaccgtgtccccggagtcggtggcggccaccgcgatcaccccgtcgtcggcacccggatagttggccgggctgcccgcggcccggtcgttgccggccgccgcgaccaccaccacacccttgcctcgggcgtaggtcaccgcgtcgctgatcgccgacgaccggtcggtcccgcccagcgacatgttgatcacgttggcgccgtggtcggcggcccagacgatgcccttcgcggtgtccgagtcgtacccgttgccgttcgcgtcgagcacccgcaccggcaggatcttgacacccggcgcgaccgacgacacgccgatcccgttgccggtcagtgccgcgacggtgccggccacgtgggtgccgtgcccctgcgggtcggtgttgccgccggcctgcccggcgatcgcgtcgtacccggtcagcacctgcccggccaggtccggatggctcccgtccaccccggtgtcgatcaccgcgacggtcaccccggcgccggtcgacatgctgcgggccgcgggcacgtgcatggtgtccagatcccactgccttgcgcggtacgggtcggtcccgtccgtggtcgcatcgagggcgtgcacccggccgtccacttcggccccggcctcttcgaggtgccggctcccggccgacgcctcgcgcacggtgatcaccggccggcccagcgggtccagcgtcgtggtgaccagccgcaccggcgcccggtcggcggcgctcgcggcggacaccggcagggccaccgtgcccagcgtgacgaccgccgtcgccgtcaacagacccgtgaacagcttgccccgcattccgtcctacctttcgtcgaccctcttcacgaaaggtgcgtccgacggagtgcgatccggtcggccgcgaggtgcggttgaggtgccgttgatccgccgtagaatcgggcgtatgcctctgaccggtgaataccagcccggcaccctcgattgggcgcgcgagcaggccgagcagtacgaagcgaccggcggcgccggcaccccggagatcatcgtggtgaccagcgtcggcgccaagagcgggaaactccgcaagaccgccctgatgcgggtcgagcacgacggtgactatctggcggtcggctccctcggcggggctccgaagaatccggtgtgggtctacaacctgcggaagaatccgcacgtcgaggtgcaggacggtgcggagcggcacgactacgacgcccgtgagctgaccggcgccgagcgggaggtctggtggcagcgagcggtcgaggtgttcccgaactacgcggagtatcagacgaagaccgagcggatcatcccgctgttcgtgttgacccgccgctgaccgaaccgcccgccgatggcgcggaaaaaggggatgccaccaggccttccgcccgcgatcatgggagtatgcggaccccccaccagcccctcgaccgtgccaacggcgcggcggtcccggccgcccgcaccccgcagcagctgccgtcggcggccatgccgctgtccggctccgtcgacgacggcgaccggctggtggatctggtcgacctgatcgccctcgacccgttcgtcaccggccgcgagccgtacggccgcaccacctggctggagaatctgcgcgccgactccgcgctgaccgtcccggacgcgcgggtgatccgcgaggcggtcgaggacgacggtcacggccggctcagcgtcggcgacggctggaccctgcacgtgatgcgctggaagcagagccgtcgcgcccgggtcacggtcaccgcggtcagcggcgagctggccgaggcgatcctcacgaaggtgaccgcgggtgcggtcgaggaaccggccccggccgacgacagcgtgccggtcggcttctggcactacggcccgcacggcccgcgccgcacccagcgggagatcggcgccgcgccctgggagacgatcaagcggaactacgccaagccggtcggcgacaccctggaacgcctgatggcgatcgatgcgtccaccgtgaccggccgcctcctgctgctgcacggcgagccgggcaccggcaagaccaccgccctgcgcgccctggcccagcagtggcgctcgtggtgtcaggtcgactgcgtgctcgacccggaacgcctgttcggtgacccggcgtacctgatgagtgtcgccctcggcagcggcgaggacgacgagcccaggtggcgcctgctgatgctggaggactgcgacgagctgatcagcggcgacgccaaggcgagcgccgggcagtcgctgtcccgcctgctcaacctgaccgacggactgctcggccagggccgcaacgcgttgatcgcgatcaccacgaacgaggacctgtcgtcgctgcacccggccgtggtccggccgggccgttgcctggccagcatcgaggtcggccggctgccgtaccgggaggccgccgactggctcggcaccaccaccgggatcgggccggacggcgcgacactggccgagctctacgccctgaagaccggggccgagccggtcaccgttccccgccaggccccgcccaccggaatgtatctgtagaagcgtgcaacctttcggccggtgaccggagcggcggcgaggaccgggtggtgcgctacgccggcggcacctactcgggggtgttgtggtgcgggccgccgacctggaacgcgctgtggacgccggcgtaggcgaggtggacgaccaggccctccgggacatggtccaggttgtggcagtggtcggcccagatgcccgggttgtcggcgacgaaggcgatctcgtaggtgtcgccgtcggccacgtccagcgagtcggtccaccacgggctgccggtggcgacgacgccgttgcggctgagcacgaccacgtgatggccgtgcaggtgcatcgggtgcacctcgccgctgccgttgtgcagggtcatccggacgatgtcgccggtgccgaccatgaacatcgggaggtccgggaagaggtggccgttcaccgtccaccacatgccgggccggccgtcgaggaagccgaagcggcggccgatgtcgtaccggaaacggcggccggcttcggccgggtcgaagccgagcggggccggcgtgccgtaggccaggagatcgaccgtttcgcgggggagcggggcggcctgcaggaccgcggccgggcttctgccggcggtcgggccggggtctgcggccgggcctgtgctagcggtcgggccggggtctgctgccgggccggggtctgcggccgggcctgggctcgcggccgggctttcggttgcgggccggccttcgggagagaccagggccgcgtcgccgccgacgtcgatccggccgggggtgtccaggtgcaggtcgacccggccgccggcggtgagcaggacgtttcggtcccggatcgggcccggctcgtggacgtcccggccgtcgacggcgatgatccggaaggtcgtgccggtcacccacacccggatcgggccggcgtccgtgttgatcagccgaaccgtggcggtggtcagcggggacgacccgggcgtgccgttgatcgtccgtttgccctgataggtatggaccatcgcgacctgcgacggctcggcctgcccggtggtggtcgcggccggctcggcgcgcggagtgatcaccagggcgccgaagaggccgttcttcacctgctcgtgggagacctggtgggagtggtaccagtaggtgccggcatccttggcgacgaagcggtagacgaagctctgcccctcccggaccgcgtcctgggtcaccccggccacaccgtcctcaccgttcggcacgtcgacgccgtgccagtgcagggtcaccccgtccgggaccgatgcgttcaccagcgtcacctggatgagctggccctggacggcgcggatcgccgggccgggcgtgctgccgttcagcgtgtacctcgcgccctccttgcgggcgaccagggtgaccgcgacatccggggttccgctcgggcccctcaggtcggcgaccgacatcccgacgccgtggtcgtgcgccaccgccggtccgccgccgctgtccggatagcccatcgcggccatgtcgtaggtgccgggaaccaggctgtcgtaccagaaatacccgaccggtccgagcacggcgagggccgccaccccggcgatggcggcccggaacgaggtgcgcatcaggcgacggcgaccggcggggcgatcgattcccgcgcctgacgcatggcgatcgaggcgacgccggcgaccgcgaacgcgttgatgccgtgcagggcgccgatcaccggcaccccgaagctgaccatggccagcacgatctgcagggcgaccacgccgacggtgatcagcgcccacttgacgccgcccgggatccgggcgaagaacgagatgatcagcaggagcagggcgagcagcgggacgaccatcatcccgatgatgccgtgcgcggcgtgcccccagtttccctcattgttcttgtcgaagacgacaccgttgtcggtgtccttgatgacgatgaaccacgcggcggcgaggaccgcggcctggacgaccacactgagtgcgatcagcccggcgagtgcccgatacagagcccgcatggggcctctcccttcccggatgcgaccacctcagcatccggccgggccgtcacgctcagcaatacgctgcacggcgtatccgcaccggacgggctactccctccgggaccatccgcttgtcaccggcgcgcggcccgtacgactccagggttaccggcgcgccgagaagagcgccgatctcccgtgcccagtcggggggccggtgcaggtcagcgggccgggcccggcccagccacgcggtcagccccgcctggtgtgccaggtcgcggtgcgggcccggcacgatccggtcgacccgctcgccgtccaccacgtacgacgtgcagatcttcaatgcgggctcgcgggccggcacgtccagatgggtgacggccagctcgtcgatgccgccggccacctcgaccgcgtaccggtgggcgaccgcgtcgaagtgcccggcccggaacgcaccctgccactcgtccgtcccgttgtgcgcctccggcaggtccagcagcggatcctcggtgacgaacgggccggccccgtgccgggtcgtgtaggtgcgcaccaccccgagccggcggaacgacgggcacaactccgccacgttcgcgaacgtggtcgtcgaccaggtggtgtgcgggtgccagccgcgccactcgtcgagcagcacaccctgcgcgccctcgaagacgcacgggccctcggcgagcagccgcatcgtgtggctctcgtgggtgatccggacggcccggccgaacgcggtgaacgcgtcggcgacgtcgtcgagtggcgcgtcgccgaacccgtacgcctcccggaccttggccaggcggcgccgcagccgcgccgggtgcagcacgtcggcgacccgcggcgcatccggctcggccagcgcgtacgccatcgtctcgccgacacccatcccgcacgaaccgtgccgctcggcgcgttcccgccgccggttcgcggcccggtgccacggggtggtcagcagcgcgtcgccgtcgacggtgagcagctcgaacgggttgcccagggcgcccgcctcggcggccagcgccagcgggtcgaccagcatgaaccgggtcaggtgggtcggcaccccgcgcagcgtgccggcgccgaactggctgaacgtgtggtgccgcccgtcgtcggtcaccacgttgtgcgcggcctgcgcacccccgttgaagcgcagcaccgcccgcacccggccggaccggcacagcgcgtcgaccaccgtgcccttgccggcgtccccgtagcccagatcgacgacggccacgtgctccatcaccacctccgcaggctgccggccagcgatcgcggggccgccgggccggtgttctcctcgcacatcccgaccgcgccggcgatggtctcgcagacctcgtcgacgttgtcgagctccagcacgtgctgcccgagcaggtcccgccaggcggccaggatcgcccggtcgccgccgtgcccggcggcggtcggcaggatgaagaacacctcgaacttgcgccgcagttcggcgagcacctcccgggtcggcagggcctgcggcagctcgtcgccgatcacggcacgcacctcgtccggcttgaccgtgtcgtacggcatctcgtcgccgatcaggaacaggtagcccttcctcccgcgggtgatcatcgagtccatcaccacgtgccgggccaggaagtacatggccagctcgtacgactcgcgccggccgccgcccccgccgccctccagcacgatccgggacaggtcctcgtccatccggttgtccgactcgaactggccgacctgcagcggtacccggtcgcaggtggcgtccccgatcgcgccgaacatgatctgcggatcggtcgcgtagccccggcgggtgagcaggccgagcagctgcggcagcttcgtctgcagcacccgcggcacgtgccgcatcgacccggtcacatcgaacatcaccacgatcggggtgctcgccgggtgctcccggctgtcccggctctcccgcatgaagacgccccgcgggtcgagcgccgggtgcgcctgccgggcgccgctgtcgctgtacgcgaaggcgctctgcccggtcgccgcgcggtagttctcggcggcggtccagacgtcggtggaccagcgtccgcttcccatgatgtgctccttctagatccggtaccgcggggggaccaactcatcgaattcggccaggagccgccacgcgttctgcgggcgcatccgtggcgcgtcgtacaggcagccgtcggcgaaccggcgtagaggcagtggcatgtccgtcccgaacagccgtttcatcaggctggtcgcgaggtggagatcggtggcggcggtgaccggctgcccggccggcacctcgaagggataccgatgctcgtggcgtgcgatgagcgctctcggtcgcgcgccgacgggggtggcgtaacaccagtcgatcaggaccaggccgcgcacccgggggtcgatcagcacgtgttcctcgaacacggcgccgtgcaccacgccggcgcggtgcgcccagcccaggccggccagcagccggcgccagatccacaccaggtcgggcagtccccgatcggtcgccgtcgccaggtcgcggaagccgcgttgccgggtcaggacattgacggtacgtccgtggtagctgaacgatcgggtcagcctgggcgcataggcccggaagccgggtcgtccgtgcgtgttcagccggcgcagggcgttcgcctcggccgccatcaggtcgttgtcggccgggtcgcgggcgatcttgaggagcaggtcgccgtcctcgaacagctcggcgatgtccccctcggcgaacagcggccgggctgtccaccgcgtcctctccggcttgacgtgtccgtccacgccgcgctcgtggtagagcgcgctgagccgggcgaacgccgcggtcgccggctcgcggcgggccgccccggccgcgtccggatgcacgatcctggccagcgtccggtacgcgtgccgggcgttcacgaacgccgtcccgctcgcggtgcgccgctcgatccccagtgctctgctgtcgatcagcccggagtcgatcagctcggcgaaggtgcgggccgccgcgatccgggcggccgcgtcctcgaaggagatccggtgactggtccgtgtccgctgctcggcggtggcgtaccccgggttcatcgcaccccgtcctcccgtgtcggccgcaacagggcggggtgcagcgaccgcgcgtcgccggcccggtagagccgtgccttgggcccgccccgctcgccgccgcgcgccgccgtctcgccggtgctctccacgaagccgggcaccgagagcaccttgcggtggaagttgccggcgtgcagctcctcgccccagaccgcggcgtagaccgaccgcagctcggagatggtgaactcggtgccgacgaaggcggtggccagcggcgtgtactccagcttggcgcgggcccgctccaggccgtcggcgagcacctggtcgtggtcgaaggccagatccttggcctcgtcgaccggcacccagtaggccccggccgcgtcgctgcccgcggtcggctccggcaggtgcggcgcgaatgccaggtaggccacggtgatcacccgcatgcgcgggtcgcgccccggatcgccgtaggtccgcaactgctccagccagacccgctccaggtcggcgtcggcctccggcccgggggccagcccggtctcctcggccagctcccgcagcgcggcccggtcgagggtctcctcgcggacgaagccgccgggcagcgcgcggtggccggcgaacggctgctcgccgcgctcgaccagcagcacgcagagctgcccgtcccggatggtcagcgcgacgacgtcgacggtcacggcgacggaggggtagtcccgggggttgtagccggccaggaagctcgcctcgtccaccatgatcaggtccttctcaacttgagtaatactcgatgtgagatgaacttagcgcgctcgatacccggtgtcaacactgccgccgcccggccgggcggcggcaggggagtgcggcctgtctacttctcgtaggtcaggcagtcggcccggtcggccgacgcgcccacggtgatcgccggggcctgacactccaggtcgtggttgtacttgcagtcggcccgtttgcaggcgcccacctgggcggtggcgacgcccatcccgccggtgagcccggagccgacgaacgtgtcgcactcggcgttcaggtccccgatggtgatcgcgaacgcggtgcacccgtcgtggttgtagccgcagtcggtgaccgtgcaggtctggacccgcggcatattcatcatctgtgtcatggctggccttcccaggaatgtggtctcgcgatggacctgccaattcgagcacgttttcggaaggcgggaatgggctccgggaaatgggcgggtgtgttaggcgagccttcctggcagcgtttatcgcgattcccgtcgatgccggtcctttggtctgacatatcaggatctttcttactctacgctactgaacccccacgaatagttacgcttccggcgagacggcccgcgacggttcatccggacgcctgggcccagcaatccagcgacgtggtccgttgggacccgtaggaggacctcgcatgcgtaagtccagaaatgccgcgcgtccccggtgggcgcgtgttggtctgacgaccggggtggtcggtgccgctctgctcgtctacccccaggcggcgttcgccgcctcctcggtaacacccccggtcgcgccggtgggtggcagtgtcaccatcaacgacaccgccccgtccccgaacttcaccacggccaccggcagcacccgcgtccagatcatcacgacgggcacctgcgcggccacctacaccacgcccaccacgtcgatcgtgtcggcgaacgtgacagcggctgcggcgcagtcgggcggcacgcccggaacagtgaccttcacggtccccaccggcgtctcgccgggcaccaacggacaggccaagcggtacatcgcctgcgtgtacgccggcgtcacgggcggcaccagcacgcgggaaggtgcggcggccggctaccccttctacgtcgggacgcccgcgacgccgtcgccggcggccggtgtgaccggtggcggtaacacggtcaccctcaccgccggcaccggcgggccgatcttcaccggtgtcacgacgatcggtgcggcgttcaccctcaacacttcggactgctcgcagacctacggcacgccgacggcgaacctggccaccacggtgacccggacctccgacacggtagccagtctcaccgtgccggccggtgtcgtctccaccaccgccaaccccaccgcctacaacatttgcctgtacaacggcaacacctcgtccgcggcgctgttctcggtggtgccctacaccgccgggcagctgcaactgagccagaccaccggcccgtggcagggcggcaacggcctgaacatcacctcgccgaaccagttcctggccggcatcgacaacccgggcgtcatcttcaccagcggagcatgcccggcggcctacgactccggcgtgacagccaccaacattccggtcgacccggtgaacagtgtccggaagctgtcgaacacccgcctggccacgaccgccccggcgttctacgggaccgcgaacgacgccagcacggcgttcggctcagccgggtcgatcacctggaacctgtgcatctacgacggctccgggaacgggacgtccaacctggtcgtcgccaacccgtacaaggtgaccacgatccagacctcgaccggggtctcgccgaaggccggcccggcgctgggtggcagcctgatcaccgtcaccggcaccgcgttcccgaccgacccgaccctgatctcggcgacgctgggcggcgtgccgctgaccgacatcaacccgctgagcaccaccgcgttcacggccaggacgccgcggcacgcgcccgccagcaacgtcgcgctggtggtcaccacggccagcggttcacacacgctgaacaacgcgtactcctacaccagcgcgctggtgatcgcgccgaacacggcacccaacaaccgggtcgtccagttggtcgtggacggcgtgggcttccagagcgccagctggggcaacaccctggtcaccggggcgcacgtcttcctggtcaagggcagttacagctccactgacaacggcaacgtcgtgcgaagcaacgcgccggtcgcggactgcagcaacgtgctggtgctcagtgacaccgagctgatctgcaagctcgacctgaccacccggctggacgctaccggtgcggccacgctgtccgcggtgccgacggcgggcaacgccgtcgtcaccaccgccggcagccggctgatcaccggtaccgctttcgcccccacggatgtcggcaaggccgtcatcgaagccgtcgacgctcccgtgatcccggccggcacggtcatcaccgacgtgctcaacgccaccacggcggtcatgtcgaacgcggccaccggtaccgcgagcgcggcagacgtgaccctggcttcgccgctgacgtcggctgccacggtgacgacgaccaactcgtcgaccggcctcaccgccgtctcgccgaccctcggcaccggcgacgtcgggaagtacatcatcggcgccagcatcccgacaggtcggacgatcagcgcgcagggtggagcaaccggaaccctcagcgcggctgccgcctcctcgggtggcggcgtgcaccccgtcgttctggccggcaccactattccggttccggagggtgcctacaacatccagtacgtcagcaacgccgctgtcaacgcggtggcgaccgatcccagctacgtgcagagccagatctccagcacgtccacctttaccgtcgccgccttctgacggaagacgccactgagcggtggcccggagcgtacagctccgggtcaccgctttcgcataaaagatttaggatgttagataatccaatgtcttcgtaagttgtctgacatatgagtatgtttcctgctttggagaatcgaaacgccgcgaatagttacgcttccggcgagacggcccgcgacggttcatccggacgcctgggcccagcaatccagcgacgtggtccgttgggacccgtaggaggacctcgcatgcgtaagtccagaaatgccgcgcgtccccggtgggcgcgtgttggtctgacgaccggggtggtcggtgccgctctgctcgtctacccccaggcggcgttcgccgcctcctcggtaacaccgccggtcgcgccggtcagcggcaccgtcaccgtcaacgacgactcggccccgttcatcggctccaacaccgaccgggtggagctgctcacgaccaccggcaccgcctgccccgcgacctacaccacgccgaccgcgtccatcctggccgcggcgtcgaccacctccagtaccacgagccaggtggtgttcgtgctgccgaccacggcgaccgcgggcagcaacggacaggtcaagaagtacatggcctgtgtgtacgccagcaacaccgccggctccagcgcccgcaagggcgccacgaacggttacccggtctacgtcggcaccgccccgaccgtttccccgacgtcgggcaccaccggtggcggcgccacgctgaccatcacggggggcaccggcgggccgatcttcacgggtgtcaccaccgtgggcgcccagttcgccacccaggccaacgactgcccgacgacctacgggaccccgacggcgaacgtggctaccacggtcacccgcacctcggactccgtcgccagcctcaccgtgccgtccggcgtcacctccaccaccgcgacgccgacgccgtacttcgcctgcctgtacaacggcaacgcgtccgcctcggcgctgatcgcggtggtgccgtacaacgtcggccagctctcgctgagccaggccatcggcccgtacggcggtgggaacaacatcgacatcacctcgccgaacccgttcctggccggcatcgacactccgggtgtcgagttcacccagggcgacacctgtgcgtcgacctataccgtgggtcagacggggggtacgaacgaaccgctcctgaccgccaacattcgtaaggtgacgaacaaccggctggcggtgacggcaccggcgttctacacctcgggtgcctacaccacggccctgggcaaccagccggccggggcgaccagcgttccgtggcagctctgcatctatgacgccgccaccgcccagggcaatctgatcgcgtccaatccctacaagacgaccaccgttcagacgctgagccggatctcgccgaatgccggcccggcgcttggtggcagcgtggtcaccgtggtcggcaccgcgttcccgaccgacccgacgcagatctcggcgacgctcggtggcgtgccgctgaccgacatcacgtcgctgagcagcaccgcgttcaccgccaagacgccgatgcacgcgccggccaacagcaacgcgctggtggtcaccacgcccgccggctcggccacgctgaccggcgccttctcgtacaccagcgcactggtggtgaacccgaagacggcgccgaacactcggagcctcgacgtggtcgtcaacggtgtcggcttccagggcgcgccgtggagcagcagcctgaccgccggggcgcacatcttcctgtcccggggcaactacagcaacgcctcggtcggcggtgcccgggcgaacgccccggtcgccgactgcaggaacgtgctcgtgctcagcgacaccgaactggtctgccggctggacctgacgaagcgtctggacctcaccggcacggcgctcctgtccgcggcacccaagtacggtgtgacggcgagcgtcacggcaggtagccgcgtcctcacggctaccggtggcacgttcgacgcctccgatgtgggtaaggccgtcgtcgaccccgccggtgtcgctctcgctaccggcacagtgatcaccaacgtcgtcagtggcacgacggcgatcatgaacaacccggcgtccgccacattggccaacaacgcgacgatcacgatcgcgtcgccgacctaccgggccgccacgatcaccaccaccggcaccaacaccgtcgccgccatcaccgggccggcgagcaccttcgtcgcctcgaccgacgtcggcgcctacccggtcaacgcgaacatcacggcgggaacgacgatccaggccgtgggcagcgacacgggcgccaccctttcggccaacgcggccaccgccggtgccagcgtcgcctccatcatctacagccagtacgtcccggttcccgagggtgcgtacaacctgcagtacgtgagcaacgccgcgctcaacgcggtgcagaccgacgccacgtacgtgcagagccaggtttccagcagctccaccttcaccgtctcggcctactgacggcgaggcaggaacacgcatcaagggtggcccggagcgtccgctccgggccaccgcctttgccctgaccggacagcgccggccgcggaagtccgcggccggcgctgtccggtggggaagggtcagccgagtttgtgccactcgcggttgatgacggcgaggctctgggccaccggtgggtggccgccgatcttcgcatcgaccgtgatgacgctgcggtgcgcgctggtgcgccagcagaccaacaggttgtcccgggtcttcggggctgcctcgttgtagaacttgaactgctgcgagcactggatgtcgccgtgcctggtgatgccgccggcgacccaggcgagttcgtgcgtgccggtcaggtcgccgtgggcggtgatgatccgcatcgtctggcccttcttggcggagccgacggtgacctccttcgcgccgtccgcctccgggtcgggcttggcgggcagcgggtgggtgatcttcacgccgtccttggcggcggcgcggcgggcggcgtcgacgcggtccttcgcggacggcggcagggacgggtcggtgcccgccttcgacttcgtgagttcgtcgccggccgcggcgatccggccgacctggtcggcggaggcgccggcgtcgggggccgcgaccgtcgcggatcgggcggtcgggctgtcgtcctgttgcgtggcggcgaagaaggcagctccggagatcgccaccgccgctccggcgaccgcaaccatggcctgcttccggcgctttccggggcgcggagtgaggtcctgggtgggttgattctgttcttcgttggccatgtcacgtccttcgagggtctcgacttggcacccggcccggcgctgatcgccgggcggtatccgaaaccccatggttccaaatatccggacatacggtgccgaatccagcaacctctcaggaaggccgggtgggaactgccgtatggctgtttcgcggttgccgccgatccggcgggggccgctggatacgctgccagcgagcgatcggccatttcggggccgtgctgtcgacgtacaaaacaattgttgtgataaatgctccagaaggagcctcgatgatctcctcgcgacaattccgccgcgccctgctcgccgggacggtgacgaccgggctcgcggtggccggcggacccgccccggcgtatgccgggagcaccgcactcccgatgacgctcagcagtgccaccgggcccagcggcggcgggaacacgatcatcggcacggtcaccccgaccgccgcgaacccgaatccgttcgtggccgggagtatgcccaccgtgcagttccagtacaacacctgcaccgcgaacgcccgggcggtggccgcgatcaccgggaccggcaccgcggccaccggtggggtgctcaccgtgaaccccgacaacgtcaagcgcaacggcaccacccggatcgccttcgaggtgccctccgcgtcgtacccggcgaaggtcgacgacaaggacagcacgatcaacacgggcgggctggtgctgaccggaacgcagaccagcgccaagtggaacatctgcgtgtacgacagtgactccctctcgaccagcacgctgctcgcccaggcggcctacaccatcggggtacggccgaagatcaccgcgatcatcccgcccagcggggcggcgctcggcgggcagtcgatcacggtgaccggggccgggttctccgcgaccagcaacgcgaccacggccagcatcggcggggtgccgctgaccaacatcaaggtggcggcgaacggcaacagtttcaccgcgaccaccgggcagcgggcggccgccaccgggctgaccctgatcgtgaacaccccgggcgggcaggtgctcagcagcgacccggacaacaacgggctgccgcaggacgccgacgacaagacgccggacgcgccgatcaccttcacctacagcaacgggatccagatctcgccgaacaccgcgccggccggcacgaaggtcgacctgctgatcaagggggtcgggttccaacagatgaccttcgacaagagcgcggacgcgacgccgacctcggtgacggcacatgtgttcctggtcaaggacgcgtacgtggcggccagcaaccgcggcgtccaggagtgcaagaaggtgctggtggcgtccaacaccgacctggtctgcacgctcgacctgggcgccgacaggctgagcccgaccgacagttcggcggtgagcggcaagacggtggacgagggcagctacacggtgacggtggtcgccaacggcgccaccgacgccggggacgcggccgcgccgaccgtggtgagcagcggcgcgacgttcaccgtcgcaccctactgacggggagactcccgatgagacgcgcactgggcctggccgccgtgatcaccaccgggttggtgctgggcgccgccaccccggcctcggccgccgcggtgggcctgacactgagcagcaactacgggccgggcgggatcatcaagacgctgatcggcacggtcccgtcgacggtgaccggcgtgacgttcgcggccggggtcaaaccggtggtccagttccagtactcgacctgcagcatccacgcgagcgccatcacccagatcacctcgaccaacggcaccgcgaccaccgcgggagtgcagacggtcgacccggcgaaggtcacccggatctccgggtcgaagatcgccttccagataccgaccgggtcgtaccccgccggcaacaacctcaacaccagcggggtcgtgctggtcaacgggcagaccgcggcccggtggaacatctgtgtctacgacaccgactcggccctgaccagcacgctgctggccaccgcgcagtacacgctgtcgctcaagccgaccatcgccaccatcctgcccgccaccagcccgtccgccggcggccagacgatcacggtgaacgggaccgggttcaccggcgtcgccccgatcaccggatcgatcggcggggtaccgctgagcaacatccgggcggcgacgaccggaaccagcctcaccgcggtcaccggcgcgcacgccgcgggccccggcatggtggtcaccatcaacgcgcccggaggcacggtgaccagcgcggacccgaacggtgacggcagcaccggcgacgcgatcgacttcacctacagcaacgggatcaccgtgtcaccgcacaccgcgagccggggctcggtggtgaccgtggacatcaccggcgccggcttctcggtgcccaccttcgaaccctcgatcggcacgccgggcagtggcaacgcgcacatcttcctggtcaacggggcgtacgactcgtccagcaaccggggcgtcgccgaatgcaccggggtgaccgtggtcagcgacaacgaactggtctgcaccctcgacctgtcgatcaacgccctggacccgcagaacagcaacctgaccggcgcaccggtgcccgacggggcgtacatcatgacctgggtcgcggacgggacgcagggctcgaccggcgccaacccgtcgatcatcagcagcggatcggacttcgtggtcgcgccctactagctgcacccgggcggcaaccggccgtctccccgaaccacaacccggctcgaagaacgtagtgcaggtcttcgagctggaggttgtggtccatgaaggttgttctgcgccggtacgccgtcggagctgtcgccgccgccgcggtcgctggagtcgccgcgttcgcgctgccgaccggaaccgtcggatggacgccggtcacgtacggcctgcaccagaccgccgaccagctgctgcccgccaccgtcaccgcggagcagccggcccgggtggtcggcaccaccatcgaccgcaacggcaagccggtcgtcacggtccgggaggcgaccacccgcgacggcgccgcgaagctcgtcgaacaggcgcagaaggcggagaacgcggtcggcgtcgagatcgacgccaaggccgtcgcgctggacgcggtcaccggcggcgacctctaccgcccgcagcagtgggacctggccaggatgcgcgccaccgacgcctggcccacgtcgaccggcgccggggtgaccgtcgcggtgatcgacaccggggtggacgcgagcaacgtcgacctgaccggcaaggtgctgaccggatgggacgcggtcgccgacaagccgggcggcaacaccgaccagaacgggcacggcacccacgtggccggcaccatcggcgcggtcaccgggaacaccgtcggcgtctcctcggtcgcgccggacaccaggatcctgccggtgaaggtgctcggtgcggacggcagcggctacatgtcggacaccgccgagggcatcatctgggccgcggacaacggcgcccaggtgatcaacatgtcgctcgggtcgacgtcgcaggtgggcgcggtcagcaatgcgatcgcgtacgcccgcagcaagggcgtcacggtggtggccgcggccggcaacgagcgggccaacggcagcccggtcagctacccgggtgcggacgccggggtgatcgcggtcgccgccaccgactcggcggacaacgtggcgagctactccaacgccggcggctatgtggacgtggcggcgcccgggtcggcgattctgagcacctacccgtcggcgctgggccgcagctacgcgacgatgagcgggacgtcgatggcgtcgccgcacgtggcggggctggtggcgctgctcaagtcggtgaacggcgggttgacgccggaccagctcgagcaggcgctggagacgtccgccgtcgacctcgggacgccgggccgggacgacgattacgggtacggccgggtggacgccgtggcggcgctggcggcggtgacggcggccccgtcgtccgctccgacgtccgcgcccacgtccgctccgacctcggcgcccacctcggctccgacttctgcgcccacctcggctccgacctcggctccgacgtccgcgcccacgtcggctccgacctcggctccgacttctgtgcccacctcggctcctgtctccaaggcgccgacggctgctccgaccaccgcgccgacctccaaggcgcccacggcttccccgacgaccgcgcccacctccaaggcgccgacggccgcgccgtcgcccaccgtggccaaggccaagccggtgatcgtggcgaacccggcccgggccgacgtcaactacggcaccaccaacgtcaccacgttcacggtgaccgcggcggggcagccgtgggtgaagaagaacgcccagctctgcgtcgccgaaagcggcaaggcgttccagtgtgtcgacgtggtcacctcggccaccggcacggtcaccgccaaccgggtcgcgaccgccggctaccagctcgaactgcggatcgcggcgacgaccgcgaacgaggccgccaccggcgccgccgcctacaccgtgcacagctcggcgtacgcggtccgcaccggcacccggaccatgagcgtcagtctcgcctcgccggccggcctgaacgtcgaggtgcagcagctgatcggcggcagctggaagaaggtcctccagttcgccagcaacgccaccaccaccaaggccacggtcagcggcctcaccaccggccagcagtaccgcgtcgtcgttccgaccaccggctcgatcaccggcagcaccagcagcatcgtcgtcgcctgaccggcggcggtggcaccagcggcgtcgtcgcctgaccggcggcggtagcaccagcgggatgcggcggcatgccggcaacgcggccatctgcgccgccagccggtagcgatggacagcaagagcgtggccacggcggatgccgcggccacgctttttccgtgaccacccgcggacggtagggcgcggcgatttgtcctggacgcgccagcggccaaaatcgccgtgcccgggagcggcgggagcggcggtcagttatcggccgcagcgtgcgacatctgcttgaagaatgtgatctggcgatctgttccgaagcggcccgcactcatcccagcgaatcccattcgcggataatgatcttggcgctgtcggcgggggtcggggcgccgtgggcggcgaccgccatcgtgatcacgctgcggcggtccgaggtacgccagcagagcagcaggtactcgcgggtggtggcgggttcgtccgggctgaagcggacgcggttggtgcagcggatgccgtcgccggcggcgaagccggtgtcggccgcgagttgcagatcgccgcggccggtgagatccgcgcgggcggtggagatgcgaacggtgccgttatgcaccgtttcgacccggcggatgaccggcgcctgctgcccctgctgggcgaccgccatcgacgacggcgcatagggcgccgacgcgcccggctcctcggggaggctcatcggggtgggtgacggggcgcgcttggcggcctccgccgggtgcgtcgtgcgcggggcccgcagatttcccggtacggcggagacgccggtgccctccatgcccggcgtcgccgccgtggtcagcggtgccagcgccgccggttcgggcagcgtgtcctgccgggcgtccatcagctgggtcacgatgaaaccggagccgacgagcaccgcgatcgcgccggcgatgccgatcgccgtctgccgacgctggaggccgcgacggtgtggcgcggtggccgcctccgaggcgtagacgctgcccccacgcgtgcggtcggggcggtcgtcgtcgctcatgtcgccctcctccgtcgctcggtggtccgtcgtggacggctcggtgttgcctgcgggcctggtgtgcggccgtttcggtgttcatcgttccaaagatcaggacataccgggctttcttcggctttctggttcgtcgctcctgcgccctcgcgcgccgctgccccctctgcccggcggatcgtgcgccaccgcctgctgcggatgcgtgctgtcggctttcggtccgagctgtcacccgcagagggaacggacgttgaccggcctgatcgacgcgcgcatcgtgtggtgcacgggtgaggttggcgggcggatcccgggggccgtcccgccgtttgtcgccggcgaggggagtcgcacgtgaccgagggcacggagcaccttcccgcccgtccgtcctgggactgccgggtctgcgcgcagccgtggccgtgcccgccggcgcgggagacgctcggacgggggcacaatcggatggatctcgccgtcaagatgtgggactacctggaagaggccgcgcgggacatgccgcaggtgccggcgccggagctcttcgaccgcttcctgcgctggacgcagtgattccgaggtttaccggcgaaagcgaataattcgcacatctccttggctagggtggcaatgacctatttgaggagttgagatgcttttccgccgtatccccgcgatgctcggcctggccgggctgctggttctcccggccaccgccgcgcaggccgccgcctccgagtcggacgccgccttcctaaaggccgctcaccaggtcaacctcgccgagatcgcggccggccggatcgcctggaccaagaccaccgacccgacggtgaaggaactggccgccaccttcctacgcgaccacatccggatggacgccgacctctacctgacggcccgtgagctgcgcgtgttcctgcccgccgaccccaccgaagagcagcaggccctggctcaccggtacgaggtggccggcaccgacacgttcgacgagtactacatcaccacccagctggccgggcaccgcgcggccctgcgactggcctccgacgaggccgccaacggctccgacgagtcggtgaaggcgcttgccgcgaaagccgtcccggtgatcaggcatcacgcggagcagctccgggacgcggcggttgcggcggggctggccggctacctcggtggtggcggccgccccagctgatcaccgccggtccgcgagtccggtgccgatcccggtgagctccgcggagcgcgcccacaaccgtcgtgcgagaaccggatccgtcgccggtccggtcagcctctcgaaggtcggccgcgggggcggaacggccggccggggccgatgtggcagccggtgggcgccgcggtgtcggtcgcggcatagaggatcggggtcaccgcctcgtcgaccggtcggctcagaacgagtcccagcagggcgccgacggcgcggtcggccggtgacgcgtcccggtccaggccggtcttcgccatcccgggtgggatcgtcttcgcgctgcgatcggcggtccgccggaggagcggatcgatcgctacctgcgggtactactcaccgggatacggtgaccggggagatcggcgccgatcagcggctggttggcagccgatctcccgcgggtgcaggtgcaggtgccagtctgcggccggttcgggccggtctgcggcgagtgggcggccggtctgcggcgggtgcagcggcgagtcggcggccggtgtgcggcgggtgcagcggcgagtcggcggccggtgtgcggcgggtcggcggccggtcagcagttagcggccggtcacagggcggctccggtggctttgcggtcggcgaagcgttcggcgaacgcggtcaggtcgcggcgttcgatggccgccgccatcagctcggggaatgcgtcgggcgtgcacgcgaacgccggcacacccagcgccgccagggccgccgcgttctcgtgatcgtaggccggcgcgccctcgtcggagagcgccagcagcgccaccacctgcaccccggcggcggtcatctccgccacccggcgcagcatctcgtcccggacaccaccctcgtacaggtcgctgatcagcacgaagatgctgtcccgcggccgggagatcaattgctggctgtacgccacagcccggttgatgtccgtcccgccgcccagctgagtcccgaacagcacctcgaccgggtcgctgagctgatcggtgaggtccaccacggccgtgtcgaagacgacgagtgacgtccgcagtgaccgcatcgacgccagcaccgccgcgaacaccccggcgaacaccaccgaggacgccatcgacccggactggtccacgcagagcaccacgtcacggtgcaccgcgctgctccgccgcccgtaaccgatcaaccgttccgggatgaccgtccgatgctcggcctggtagtgcttgaggttcgcccggatggtccggtcccagtcgatgtcggcctgccgcggccggttgatccgggcggcccggttcagcgccccggagaccgcggcccgggtctgctgggcgatccgtttctccagttgctcgaccaccgaccggaccacctgccgggcggcgtccttggtggcgtcgggcatcaccttgttcagcgagagcagcgtgccgaccaggtgcacgtccggctcgaccgccgccagcatctccggctccagcagcagtcgggtcaggtcgagccgctcgatcgcgtccgcctgcatcacctgcacgacggtgcccggaaagtactcccggatgtcgccgagccaccgcgcgacccgcggcgccgacccgcccagccccgcggaccgcttgctgccggtcccgtccccgtccccgccggagtcgtagagcgccgccagcgccccgtcgaccgccccgtcccgcccctccgccttgccgagcgactcctccgccgccccacccagcaccagccgccaccgccgcatccgctcccgcgccgccccggcggtgctctccgtggtcgacgtggtctcgtcagccatcggcgcgcccggttcgacgtgctcgcccgcctgtgccctcacggcgactctccgcgcccgtaggaccgtcaaccgcccggccagcccgatcgcccccttccctgcgcccgcttcgtcccgtcgtctgtcgtccgtcgtccccgcggccgccggtgccgccgggccggtcggccgcccgcccgcccgccgcttgccgatcgccaccgcgttcgccggccggatgtccctcggccgcacgcgggccggccgcgcgtccttccgcgccgctagctagctagtccgccggcgccgcgtcctccggtgccccgtccacccgggccgcggtcccggtttccgctccggttgccgccacgcccgccgccggcctggcccgcccaaccggacatctcatcgaactccgtcgcgccccgcgccggacccgggtgggagaacagccgccccgccggctcggccgcgtgcgaggcggagccgatcaccgcctcctgcgtcggatgcgagaactgcagcatcgtcggcagcgcaggcgtctccccgcccgccggctgctcggccgagtgggaaaacagctcggcgtcctcagaactctggctcatgcgtcctcccggacccggatctcgcgccccagcagggcacccagcacgggcagcacggacactgcccgtttctcgtcgatcgtcacggctgcggcctgcgccgctccggcccgcggaccggccacccgctcaccgatcgcccgccgctcgcccgcgtcgaatgtcccgaaggtacgcctcagcagcggcaacacatcatcgaacccctccgccggcacgtcggcgagccactcgtcgaccagcgtgagcagcgcatcgtcgtgcaccagcagcagcccgccgccggccaggaacccctccacccaggcggccccgtgcgccggtggtgtcccggcggtcagcggcagccgcagacggcggcggacctcgccggcatccagccggtcagcgtccagcagcagccgggtcagtcgcccggccggcaacccgtgcaggtccggccggcgggccagcgactccagggtcaccagccacaattctcgcagatcgtcgtcggcgagcaggccgaccgcctgatgaacgccgtccacgccgtcccgcagctgcctggccgcctcgtcggagagcgaaccggccgccgacggcagtccggcgcagatccgtttcagcagactggcggtgaccgtcgcgagaccgccgacgtcggtgcgccgcacatcgccgtaccgcagcgtccgggccagggcggggagcgccgccatcaggtggtgaatgtcggcgtccagcgcggcgcgggtgtccagcgcggtgagaacccgcggatacgcatcccggagatcggccagcaggcacgtttccagcagcgcggtcacctcggccagcgtctgcgccgtgctcgcccgccgggtcacccgggcggtcgccgcggcggccaccgtggtgccccacatgctgccctcgacgagccgcaccgcgaactccggctgccaccgcagcacccattcctcgcggaaggtgcccgtcccgcggcgcccgggagccggctcgccccacggcacggccagggtccgcaaccggtgcaggagccggctgcgccgcaggtcgatctccttgcgcaggtcgagtctcagctcccgttcggtggcttcgggtttgagccgcaggctccgctgctgggcggccaagtcccgagccagcggaacggccggcatctcgtccggcaccgagccgagccgctcgccgaccaccagccgccgattgatcagagccgtgcgcagcggctccccgtcgcacatcaccgcctcggcggcctcggtcacctcggccagcccggccagcggccgcccccgcagcgcggcgagcgcctcggccagccgggtcgcctcgatcacgtgcgccgaggaggtggggacaccctcggcgcgcagcacgccggcggcgtccaccagccaccgcggcacgaccgagtccgcgctggtgaacaggtggtgataccaccccggggaaccgaccccggcgccgtacccggaccaggaggccagccgaccatacgtccagggcacccaggtgaacgcgaccttgcccttgcgccggcccttgagcagcgcgttgtcatccttggccggcaccttccgggtcagcgccgggacgtgccacgccccgcagacgaccgcgatgttgtcgtgcttgcgccggacctcccgcaggaccgtgcgcatgtaggcctcccgcggaaggtcctcgggatcctccgcggcgccttcccggatcgccgtcattgcttccgcgatcgcctcgaaagccggcatcccgcgatgctcgaccacgtcctcccaccagcgctccggatcgtcataccccgccgcggcggccagctcaccgatcggatccaccggccgtccgggcgcggccgtccggtccatgtcgccgccggcctcagcgtcgccgtccccacgggacggctggtcaccctcgaccgggggagaatcgccgacccgcggggaagcctcggccggggcgggaccaccgtcttcgtcgccgacccgatacgcgtagggcaggtcgaagaagcggaccggcacctcgttgtccaccgcccaccggatcgcctgccactccggcgagaagaccgcgaacggccagaacgcggcccgccccggatcgtccaccgcatagcccagcagcgcgaccggcggctccaggtcgctgccggccacccagcgcaccagctcgtcagcctccggcgggccctccacgagcagcaccgtcggctgttgcgccgtcagctcccgcaccaccgcccgggccgagccgggcccgtggtgccggatgccgtagaacctctcaggcatcgcgcgcggcccggtagaaatcgagccagtcggaccgctcccggaccacggtctccaggtattcccgccagacgacggtgtcggagacggggtccttgatcaccgcgccgacgatgccggccgcgacgtcgcccgggtgcagggtgccgtcgccgaagtgggcggccagcgccatcccgttggtgatcaccgagatcgcctcggcggtggagagcgtaccggtcggcgacttgagcttggtgcggccgtcctcggtcagcccgctccgcagctcgcggaacacggtgaccacccgccggatctcgtcgagcgcggccggcacctcgggcagctccagcgaccggccgagctgcgccacccggcgcgccacgatctcgacttcgtcgtcggcgttggccggaaccggcagcaccaccgtgttgaaccgccgccgcagggcgctggacaactcgttcaccccgcggtccctgtcgttggcggtggcgatcaggttgaagccgcgctgcgcctgcacctcgtcgcccagctccgggatcggcagcgtcttctccgagaggatggtgatcagagcgtcctgcacgtcggacgggacgcgggtgagctcctccagccgggcgatggagccaccccgcatggcccgcatgatcgggctcggcaccagcgccgcggcggtcgggccctcggcgagcagacgggcatagttccacccgtaccggatggcctcctcggcggtgccggcggtgccctgcaccagcagcgtggagtcgccggagatggcggcggccagatgctcggagacccaggtcttggcggtgccgggaacgcccagcaggagcagcgcccgatcggtggcgagggtggagacggcgacctcgatcaggcggcgcggccccacatacttcggggtgatcttggcgccgtcgccgagcagataggtcaccacggcctggggcgacaaccgccacccgggcgggcggggtcggtcgtcggcggcggccagccgggtcagctcgtcggcatactgatcctcggcgtgcggtcgaagagcggtcactcgaactcctgagtctccgggcccaccggcccgcccgatagctggctcgaactgcaaactaccgccggggtacgacatttcccggcgctgccccggcgccccggccgaccgatcgcacggcacgcccggcccgcacgatcgacccccggcacacccctcacggctcgctcaactcgcgcagcatctcctcacggaacgccagcgtccgcgccaggtcggcgatcggccgcacccggctcgggtccacctccggctccagctgagcggccagccggccggcgagatccgcatacgccgggggcatggcgagcgcggcggtccggcacagctcgccgagctgccaggtgtgccggtcgtgacgcgcccggcgcagaatcgtctccagcaccgtcacgctcagtggttccggccacggcccgggatgcagtgccagcagtcggtgcgccgcggcgtcctcggcacgcagcgcctcggcggccagccgggccaatgtgtcggacgggagcaccaggtgcagttcccagcgaaccccctcgcgcagcatgccggagtcgccggccagcagcgccgcagcccagcgggcgtcgccctgggtgatggcggccttggcccagccgtgcagcagcggcgtcacccagtcgtttccccgggccagcgcgaggtaaccggtcggctccagggcggcccacgaggtgagcggagtcccggcgaccacctcctccagcagccaggcgccgaccccggtgccgtgggccggggtcgcgctcaccccgtcacgtcgcagcccggcgtccagctcggccggcggcgtcaccaggagccgcgcagagtcggcggccaggcgcaccgcggcgtgcgcccggtcgcgcatccgctcgccgagtgccgccccgggcaggcggcggagcaggtcgacggcggtctgccggacctccttgcgccggtcgtcgagggcccgctccagcagctcctcgtcgtcgagggacagcccgtcggtgaaggcgccgaggaaccgggcgcggttctccgaggagtcggcgccccaggtgctctccaccagccgccgcgcgtgcgccggctcggaccggcgcagggtgatcaggtgtcccagccgctcggtgccggtcgcggtcgtccagtcgaccacggtgaccggcgtggcctcgtcgaacagccagccccagtcggcacgccgctcggccagccaggcaccccggcgcccggcgacccgggccgcgtcggcgcggatcgtcgtggtgcctagctagctaggccaccgggtcacccagtcgggcgcgggatcctgcccggcgccggcctcggcccagcgcagcaccaggccgacggcatgcttgcagggcgtctggaaactcgggcaggagcacttgaacgcggggccggacaggtcggcggcgacctgatagccccggcacagtccccagaggacgtcgtcgagcagcccgacggggccgaactgcccggccacggagcgggcacgcttgagcgccgaggcgtcgggagcgatcgactcggcctgggcgatggaccatcgttcggcgggcacgggacgaccctaggccgggggtacgacgttttcgggatggaccacccggcctgtggacaaccgggcgccgaaccacccgcctgtggaaaaccccggagcgccggggtggtacaacgccgcttacccgctgaccgctccgctaaggccggcgctccgccgcctcgcgcccggccgggtgaccaccaccgaggcgcccggccgcgggatgctccgggccgcccgcaccggcttgccgcgtcgcgtggtgaccgacacggacctgcgatgaggccccctgacgacgaccgcgatccggcgatgactgaccccacagcaccgcggcgaaggccagggccatgccggtgacctgcaccggcgtcagcgcctggcccagcgccgcccaccccagcacggtcgcggtcaccggggagagcaggctgagcagcgagacccgggtggccggcagccggtccagcccgcggaaccacagggtgtaggcgagggcggtgccgatcagcgccaggtatccgtagcccatcaggttccggccggtcagtgacgccggcagcccctcgccgagcagcatgatcggcagcaggaccagtccgcccgcggtgagctgccacccggtcgcggtcagcagcgagacgccgggccgtccccaacgtttggtcagcaccagaccgatggccatcgacgcggcaccggccagcccggccaggatgccgatcgggtcgaggcgggcggcggcggtcaggacggcgagggcgacgccggcggcgccgagcaggcccgcgatcacggtacgggccgtggtgcggtcgccgagcacgaccgtggacagcccggcgaccagtagtggctgcaccgccccgagcacggccgccatgccgccgggcaggcggtaggcgctgacgaacagcagcgcgaagaagaacccgatgttcagcgcgccgaggaccgcggaccgccaccaccaggcgccgcgcggcagttgccgggtgatcgccagcagcaggagtccggcgggcagggcccgcaggacgccggcgagcagcggccggtcgggtggcaggaattccgtggtgatcgcgtaggtggtgccccagaccgcgggtgtgagggcggtgatcagcaggacgcgcacggcgactccctcgatgtaaagtatctcgacatcaagataacctgtgtcgagaagcttgtcatcgagaggtcgtgcagaatggcggcatgagggaacccgacggtgtcgatcggatcctggcccagtgggccgtcgagcgccccgacctggaaaccactgcgatgggcgtcttcggccgcatccagcgcatcgcccgcatcgcctcggacgccggcgagcgcgcctacgcggcgtacggcatcggccgccccgaattcgacgtgctcgccaccctgcgtcgctccggagcgcccttccggctgtccccgggcgccctggccgcctcgatgatgctcagcaccggtggcaccaccgcccgcctcgaccgtctggagaaggccggcctggtcgcccggtcacccgacccggacgaccgccgcggcgtcctggtctccctcaccgagcagggtttccaggttgccgaccaggccgtcaccgccggcctcgccgagcagcagcggctcctggcccacctcaccccggcccagcggtcccagctcgccgacctgctgcgagcggtactcagcggagactgaccgggcccgggggagtgccgtcgccgaacgggcggccgccgaggggactcacggccgtgcggggtgtgccgggcgctcggatccgggccggccgggacgacacagccggcggacgatgatcgcgcggctcaccaccagccgacatcgcccggcttcgccgggatggccgtcgcgcccgtcggcggtgatccgggtggtgaggtagcgctgatcacgctggtcctcgccggctgtcatgggaccacggtgccccggcgggcccgctggcgccggaccccgggcttcgcctaattttctttctcatgtacgccgtcgtcgacctgcagaccaccggcaccaagaccacctggcacgaccggatcgtggagatcgcgatcgtgcggctggacgagaccggcaaggttctcgacgaatggtgcaccctcgtcaatccggaccgggatctcggcccgcaggagctgcacgggatcagcggcgccgaggcccgccgcgcgccggtcttcgccgagctggccggtcagatcgccgagcggctggccggacgtctgatcgtcgcgcacaatctgctcttcgacgccggcttcctcaccgccgagttcggcaagctgggtgtcgccgtgccggtcgacgacgagcgcggtctgtgcaccatgcgcctggccggacatttcctgccgaccgcgtcgcggagcctggcggcgtgccgggccgccgccggactaggtccgcaccgcgaacagtccgcgttgcacggcgcccgggccgccggcgagctgctcggttactacctggagcgggcgggtgatccgccaccctgggccgagctgctggacagtgcccggcaggccgactggccgcggctgagagtgaccacggtcgccgccgtcccgcgtcgccgtcccgaggagcgcgagccgcacttcctcacccggctcgtcgaccgcctgccccgccagctcgacccgaaggccgacgcttacctggcgctgctcgacggtgtgctgctggatcggcacatctcggcgagcgaggccgatcagctggtcgcgatcgccgccaggatcgggctgtcccgggccgacgccgagctgctgcaccaccgctacctgtgtgggctggccacggtagcgctcgccgatcagatcctcaccccggccgaacgcctcgacctggacggcgtcgccgagcttctcggtctcacctcggccgacgtcgaccgggcgctcgccgaaccggccgctcaggtcacccggtggcagctcaccccgggtgaccaggtcgtcttcaccggtgacctgcacccgccgcgcgagcatctcgaggtggacgcgctgacccacggtctgcggaccgcgcggaaagtcaccaaacagacgcgactgctggtggcggccgatccggattcgctctccggggtggccaagctcgcccggcagtacggcattccgatcgtcaccccggcggcctacaagacgatgctcgaggcgttgctctccgcgcagcgttgacaacccgattggtggtacgtcgtgaggcgcgccgccgcgcaccgacccggtccggcgggacaccgcggcccgcggcgatggccgcccggggtggacggccatcgccggatgctgtggggcgaggcatccccccgtgtgcgacgcctcgcccggctcagggcgccgggcgtggacgcacgtgtcagaacacggccggagcccgctgctggaccgcggcccacgcggcagggcctttatagcacggagggagagcgctttccttggccctgacagagatttgggagcgtgcccaagctgctgagcgtcggcggggtgacgctgtggtgatcaagtcgcctgatcgggggttcccccgtcccgggtaggcgggtgccgaccgctatggccgggtttccatgatctggatcttcggacttctctccgaactccgccccgttccggcctaaccctcacgacgctggcgagccggcaccgggttgtcccgggggcgaagagtggggtctgccgggctgtgccgggctttaccttgctcgaacatggaagcggatcggagggcggcatgatgtggcggtgagcgatgcgtcgaaggggctcgtcctggtcgtcgaggatgagcggccgatcgccgacctggtccggctctatctgagccgggagggattcggggtgcaggtcgagcacgacggcgccgcggggctggcggcggcgcggcggctgcggccggtggcgtgcatcctggacatcgcgctgcccgggatggacgggacggagatctgccgccgactgcgcgccgacggcgactggacgccggtgatcttcctgaccgcgcgggacgacgaggtcgaccggatcctcggccttgagctgggtggggacgactacgtcaccaagccgttcagcccgcgtgagctggtcacccgggtcaaggcgctgctgcggcgggccgccgggccgccggaggaggacggcgtgcgccgactgggcccggtcgcgctcgaccggagccgccgcgcggccaccgtggacgggcaggcggtgacgctgaccgcgaccgagtttgatctgctcgcgcacctgctcggccggcccgggcgggtgttcacccgggaggagctgctggccgcggtctggggctacgcctcgcacgccggcacccgcacggtggacgtgcacgtggcccaggtccgggccaagctcggcggcgcggccggcctgatccgcacggtccgcggcgtgggctacaccgccgatgcgtgacattcggtggcgggccggggtggtccgggcaggtggcatccggtggtggcgggccagggtggttcggacaggtggcatccggtggtggcgggccagggtggttcggacaggtggcgtccggtggcggcgggcaggtgccggtgggtcggatcggggcggcggggatgcgtgagttcctccggacgctgaccgggcgggcggtcctggtcaccgtggccacggcggtggtttcggtgatcgtgaccgcgctggtcgccgtgccggtggcgatgcggtccacgaacacgcaggtgcgcgccgagctggtggagaagtcggcgatcgccgtcgagctgctcaccgacgagaaaccggccgcccgggaacggatcgcgaatcgtctgcgagccgacgacatcgagatctacctgatcaggcgtggtgtgccggatcgcgccgggctgccgccccgggtgatcgcccagatcagcggcggcgccctggtcgacgcggccggccgggtcggcgggcggccctcgttcatcgccgggcggccgctgaccggggtggacgccggggtggtgctgacccgaccggccgcgtcggggctggcgctgcgggtgctgggcagcgtctggtgggcgctgctggccggcctggtcggtggggcgctctccggtgcgctgctggcccggttcgtgacccggccgatcgagctggccgcggcggcggccgggcggctcgccgcgggggaccggtcggtgcggatcgcgcggcacggtccggccgaggcggtgcggctcgccgaggcggtcaatcagctggccgcggccctgcagaccagcgagggccgggaacgcgacttcctgctgtcggtctcccacgagctgcgaacgccgttgtccaccatccgcggctatgccgaggcgatcgccgacggggtggtcgccgcggacggcgcgccacaggccggggcgaccatgctggccgaggcggaccggctcgaccggctcatctccgacctgctggtgctgtcccgcctggaggcggccgacctgcccctggacgtggtccgggttgatgtggtcgagctgatccgggaggccggccgggcgtggtccgcgcgctgcgcggccgacgggccggcgctgtcggtggagctgccggacgccccggttatcgtcgcgacggacccggggcggatccggcaggtcctggacggcctctgcgagaacgcgctccgggtggtcccggccggtgcgccgctcgtcctggcggtccacgcgggcgggtccggtgcagtggtcgaggtgcgtgacggcggccccgggttcaccgacgacgacctcgcggtggcgttcgagcggggggcgctgaaccggcgctaccgggggatccgcaaggtcggcagcgggttggggctggcgctggcggcgcggctggtcgcccggctcggcgggcggatcacggctgggcacgccccggagggaggtgcgatgttcacggtcgagctgcccgacgagccggccgaccccggcacgctgcgatgagcgaccgtcgaagcccgtcgactgatccggaggcgctgaggtgagcggccccggcatgcccggcggctggtccggaggcgctgcggtgaggggctcgaggatgcctgaaagctcgtccggaggcgctgcggtgaatggccgccgtggcctgccgggtgctgcggaagcgcttcgatgaggcgggtcggtggctcgtgcggggccgcggccgctactgcaggaagtcggcgaacggggacaggagcaatttgcccagcccggtggccgtgcggtccaggtggcggcgctccttgtccagggcggtctggtcgtgccggagcgcccagatcttctgggcgttgcgccaggcgacgttgcgggtgtattccaccatttcgccctgccaccagtcgtcgaggtcgccgttcatcgtgtcgatgagcagctgccagcggtcgagatagccgcggcgcaggcccgggatctcctcggcgaagatgtcgttgacctgcaggtagtcgtggtgctggtcgctgtcgtcgaccgggccggagcccaggtggtcgaacgtcgtgaccagcgcgaacggcaggtcgaagttgacatgcgcgttgacgccggcgaccgcggacggcagcaggcgggggcccggcccggggacccgggagaacaggccggcccacgccccggggcaggccgggctgccgtgggtccagtagcgcagggcgtcgaagtaccgggcggcgaactccacgtccagccgggacaggaacgccggatccttgaacctgcccgcatacagccggtccagcacgttctcggtgatcgccaggtagagcctgttgaaatcggccagcgggttaccaccgagcagcggcggcacctggcagagaacgtcctgcaacttggtgagctggtcgacgacggcgggcacgtcgtccgggtgctcctgcaggatcgcggacatctcggcgtgcacgggcccccagatgggctgggtcatcggatcctccacggacttgctgatgtgcggagggcccccagcaccgcccggcggctgtcaccaccgggcggtgctcccccgtgccacagcctttcaccggcgccgtacgaggggatcggtaaaacgacgtattccgcgtacgtatgtcacggcgtgataacgaatacctggtcaggctgcggtaagaaaaacccggctggcctgtacgcgggtacgcacctggagcttgtcgaagatgtggcccaggtggacgccgacggtgcgttcgctgatgaacagcaactcaccgatctcccggttcgtcaatccctccgccacggcggccagcacctcacgctcacgtccggtgagaatggccagctcatcgccgggatccgactcgggcggcgcgatcggcacggtgtccgcgtcgtccgagagggcgacccggaaccgctgcgccaccgccttgatctcgttcgccagcgggcgggcgcccatcgcgatcgccgtcgtgtacgcctggcgcagcccgttgatcgccgccgtccgccgcgaccggcgggccagcgccacctcggcgtgccgcagccgcgagtacgccgccggatagggctgctggcggcggtcccacagggcggccgaccgcgcccagggctcgggatcctgccggtcctcgacccggctcagctcggccgcggacaggtagaggtagccgtcgagcaccgcacggacctcgggagcggccgcgttcgcccccgcctccaggcgcgtcaccacggtcttcagccggcgcagcgcgcccgggtcgaccggcgagccggcggcgtgcgcctccgcctcggcccgcaggccgtgccaggccagcacgccgagcagcaccaggtcatccgagcgggtctcggtgaggccgcgctgcaccgcggcccgggcgtcggcgtgctccttctgccacatcgccaggccggcccgcagggtgagcatcggcagcacatgccgggcgccgccgccggccagcagggtggcggccgcgtccaggtcccgccgggcgttgtcgacctcgccgaaaccgacccacaggcggctgcgggcgagcagcagctcgaccgcgtcggccccggacgggcggtgccgcatggcctgctcgaggaccgcgtcggcctccgtccactgaccgattctgaacagtccgttgccggcgatcgcgagcagccgcgtctgatacgtgcggccggcgccgcggtcggccagccgctcggcgccccggcgggccaccagcacgccctcctcgatgctgttcaacgggccggtgagcagctcggccaggtgcaggtaggccacgcccaggtcgtccgggtgaccggatcgctcggcgatctccacggcgtgccggatcaccgccaggccggcgtccgggtcctcccggaacgcggcgctgaagcccagcgcggcgctggcccggaccagatcggcggtggcgccgttgatcgcggccagctccagcgcctcccgggcgtgccggttggcgtcggcgtaccgccccaggtgcagcagcagctcggcgaggaaggcggcggcggtggcgcgcagccggggggagcagtccggggactccagggccagctcgtactcccgctcggcgggctccgagcggccggcggcggcgagataccgcgcgcgacgcaggtgcagctcgccctcgacgggggcgtccttgcggccggccagctccgccagccgggtcagcgccagctggtgctcgccgcactggtgggccgactcggcggcgtgcccgagcagctcggtgcggtccgcggcgtcgtcgtcgatcagccgcagggccagggtccagtgccggtgcgcctcggcgaacccgtacagactctccgcggagcgggccgcggcgaccaccgacggcagtgcccgggacggcaaccccgcacgctgccagtggtgggccagacgggcgtgatccgggccgttcgggcaggcctggagggactcggcgtaccgccggtgcagggcggccgcctcggccggcagcacctcctgctccagcacctcggcgaccagccggtgccgcagccggtaaccgtcgccgtcgccgaccacgaaccggtacgccaccgcggcgcggatcgcctccagcagctcgtcctcgggcaggcggaccacccgggacagcaccgcgtgctcgaccggctcgaccccggcggccagcgcgtgcaccaccgcgtgcgcgttcggcggcagttcgtcgacccgggccaggaagatctcccgcagtgtgtcggacagctcgacccggccgtcacgcagatcccgggccagctcctcgaccacgaacgggttgccgccgctgcgcttgtgcacccgatcggcgtcctcgccggtcaccccgtcgccggcgatcgcggtgaccagttcgcgggtctgctcgtggtcgagcggggccaggtcgaccacccggaccgagcgcaaccggcgcagctcggccagcacccggcgcagcgggtgggtgccgtgcagggcctcggcgcggatcgcggcgagcaccgagacgcgcacgtcacccaggccggccagcaggtagagcagcagctggcgggtgctccggtcggcccactgcaggtcgtcgaggaccagcagcagccgctggtccccggcaatcgcgcgcaggtcttgcgagacccggtcgagcagcgcacccgggccgccggcgccggtggccggcgcgctgtcgtgccggcgcagcgcctgcagcaccgggtgcagcggtgacgcgtcgccgatgtccaggcaggtgccgaagagcaccgcgaatcccccaccgcgcagcgcgtcggcggtctcccgcagcagccggctcttgccgacgccgctctccccggtcacgaagaccgcggctgtcccgccgggacccgcgttgcgcaggtaggactgtatgtcggccagcgtgccggtgcgcccgacaagcggcccgtcgtccccctggctggccatgaccggcagcctaatgcgaaatcccttaccgccatgtcgtcggttcggactgttctgcgtcacaaaaatgacgagcgttgatgctgtcagagatacgtcgttctgcggatccgcagggggagcgcggctggcaccgtactcccggtcaacgcagtgatctggggagcgtgagacatgaccaccatcaccgtcgccggtcaggagcggcgccagaccgtgaccgtgctgttcgtcgacatcgtcgggttcacctcgctggtggaccggctggactgtgcggaggtgcgggcgttgcaacgggactacttctcggtcgtcgcccacgcggtccgcgactgcgggggcatcgtcgagaagtacgtgggagacgcggtgatggcggtgttcggcaccggcgtggacggcttcgagccggcggcggccgccgcggccgtgcgcgcgggcctgtcggtccagcaggcgttgagggggcgcctcctggccggccggcaccgggtccggacccgggtgggtctggccaccggcgaggtgatcgtggatccgttgatgaccttcgacggggggtacgcgatggtcagcgggagtgtcgtgagcaccgcggcccggttgcaggcgtacgccccgcacgacaccgtggtggtctgcgcggccacccgggacgtcaccggcgacctgatcgcgtatcaggagatgccgccggtgtcggtgccgggcaagtcgtacccgctggacctgtggcgtgcgctacagccgcagaccgccccgctgatccggtccgccccgctggtgggcgctcgctagccggtttttgtaacctttttcccgaattttcgggctgagcgggcacgacctggctcgcctggggcagaagtgtcggaggggccgggtaggctcgcgccgtccttgaccaccaggcttatcgggagtgccgcctcgtgaccgcacagccagagaccttgtacggggctgctgacctcacgcacctggaggggctggacgctgtccggaaacgcccagggatgtacatcgggtccaccgacagccgggggatcaaccacctggccaacgagatcatcgacaactgcaccgacgagggcgtcggcgggcacgccacccggatcgccatcacgttgcacaccgacgggtcggtccaggtcgacgacgacggtcggggcatcccgaccgacgtgcacgccaagagcgggctgagcggcgtcgagctggtgctcacccggctgcacgccggcggcaagttcggcggctccggctacaaggcgtccggcggtctgcacggcgtcggcgcctccgcggtcaacgcgctgtcactgcgcttcgacgtcaccgtcaagcgggacggcaaggtccacgagatctccttccagcgcggcgtgcccggcgtcttcgacggcccggggccgcaggcgtcgttcaccccgcaggccggtctgcggatcgcccgccggatgaaacgcggcgagcccaccggcacctcgatccggtactggtacgacgcgcggtatttcgagaccggcgcccgactcgacgtcgaagcggtccgcaccaagctgcgcaacaccgcgttcctggtccccggcgtgcagtattcgctgttcgacgcgaccgccgaggagccgcacaccgagaccttccactaccccaacggcctggtcgacatggtggagttcatgactccggccgccgacaagccggtctccgggatcctggtcgtcaccggcgaggggacgtacaaggagaatgccgccgacgccaacggcgtcatgcagtcgaacgtcgtgcggcacgctcaggtcgagatcgccttccgctggggtacggggtatgagcggtccgtggagtgcttcaccaacacgatccgcaacgtgcacggcggcacccaccgcaaaggcttcgagcgggctctggtccgtgcgctgaccgaggccatccgcaacgcacgtggcctgctcaagcccaaggaggagccgcccgtcctggacgacttcctggagggcatgaccgcggtcatccacgtccgggtgccggagccgcagttcacctcgcagaccaaggacgagctgtccacggccggcgtcacccgggtgatgcagaccctcgtcgagtcgtacctgaaggagtgggtcgacggccggcgcaccaagaccgaggcgcgcaccgtcctgcagaaggtggtcgacgccgcccgggtccgcctcacccagaaacagcagaaggacgcggcccgccgcaagaccgccctggagggcgcgtcgatgccgcccaagctggtcgactgccggtccaccgggatctcccgcagcgagctctacatcgtcgagggggacagcgcgctcggcaccgcgcggatggcccgttcgtcggagtaccaggcgctcctgccgatccgcggcaagatcctcaacgtgcagaaggcgagcctgcagcaggtgctggacaacgccgagtgctcggccatcgtccaggtgctcggcgccggctccgggcgcaccttcgacatcggcgcgatgcggtacggccgggtcatgatcatggccgacgccgacgtcgacggctcgcacatccggacgctgctgatcaccctgttcgcgaagtacatgcgcccggtgatcgaggagggccggctgttcgccgcgatgccgccgctgcacaaggtggtcaccaaggggcgcaacggcgacaccgtctacacgtacacccagcaggagatggagacgaccgtcgcgcgcatcgagcgctccggcaagtccgtgcagaaaccggtgccccggttcaagggcctcggcgagatggacgcggacgagctgtgggacaccacgatgaacccggcttcccgcaccgtccggcggatcacgctggacgacgccgagcgggccgaggccaccctcgaactgctcatgggtgagcgggtcgagccccgcaagaactggctgatcgacgcggcgggccgcatcgatcaggagacgatcgacgcctgagaggtccttgtccatggcacgccgcaagacccccgacaaccgcgtcgacctgtccgctttcgaccaggccggcgcccgggtcatcgacaacccgctgaccaccgaggtcgaggactcctacctggagtacgcgtattcggtgatccactccagggccctcccggacgcccgggacggcctcaagccggtgcaccgccgcatcctgtggtcgatgtccgagcagggccaccgccccgaccgcggctacgtgaaatcggcccgcgtcgtcggcgacgtgatgggtaaataccatccgcacggcgacgtcgcgatctacgacgcgctggtccgcctcgcccaggatttctcgctcaacgtcccgctgatcgacgggcacggcaacttcggctcgcccgacgacggcccggccgccgcccggtacaccgaggcccgcatgtcccgtgaggcgatgctgctggtcggcgagctgggcgagggcaccgtcgacttcaagcccacctacgacggcgacgacgtcgaacccaaggtgctgcccgccgccttccccaacctgctggtcaacggcacgtccgggatcgcggtcgggatggcgaccaacatgatcccgcacaacctgggcgaggtggtcgcggccgcccggcacctgatcacccacccggacgccgacctcgacgagctgatgcgcttcgtccccgggcccgacctgcccaccggcggccagctgctcggcctcgacgaggtgcgccgggcgtacgagacgggccgcggcgtggtccggatgcgcgcccgggcacagaccggcccgctggagggcggccgggggcgtcaggccatcacggtcaccgaactgccgtacggcgtcggtgccgaaaagatcatcgaggcgatcaccgacgaggtgaagggcaaactgctcacctccgggccgcggcgcgggcagcggcaggcggcccggttgcagggcatcgccgacgtcaaggacctcaccgaccgcgagcacggcacccgcctggtgatcgagtgcaaggtcggcgtcaacccgcaggcgctgctcgccgacctctaccggctcaccccgctggagacctcgttcggcatcaacaacctggtgctcgtcgacgggcagccgcgcaccctggggctcaaggccctgctggaggtgttcgtccagcaccggtacgacgtggtcacccgccgcaccgagttccgccgcaccaagcggctcgaccggctgcacctggtcgacggcctgctcgtcgcgctgatcgacatcgaccgggtggtcgcgatcatccggggcagcgacgacgcggccgcggccaaggcggccctgatgagcgagttcagcctcagcgacatccaggcgacctacatcctggacaccccgctgcggcggctcacccgcttcgaccggatcgagctggagaccgagcaggaacggctgcgcgccgagatcgccgagctcagccggatcctggacaacgaggacgtgctcaagcaggtcgtctccgacgaactggccgaggtgaccgccgagttcggtcgcccgcgcaacaccacgctgatcgacggcgacctcaaggaggtgctcgccgcgtccgcgccggccggcccgctcgaggtcgccgacgacccgtgccaggtgatcctctccgccaccgggctgatcgcccgcaccgcggcggagagcgaggagtccgccgaggcccgcaaacgcagcggccgggtcaaacacgacgcggtccgggcgatcatccactccaccgcccgcggccggatcctgctgatcaccaaccggggccgcgccttcaagaccgacgtgctgccgctgccggtgctccccgaacagtccggcacggtgtcgctgcgcggcggcatgtccgcgtccgagctggtcccgctggaaaagggggagacggtcgtcggcctggcgccgctgaccaccggcggcgactccccgggcctggcgatgggcacccggcacggcgtcgtcaaggtgtgcgcgccggagtggccggtccgctccgatgaattcgaggtgatcaccctcaaggagggtgacgaggtgctccaggcgacctggctgaccgacggctccgagtccctggtgttcatcacctccgatgcgaacctgctgcggttcccggccaaactggttcgcccgcagggtgtgaagggcggcggcatggccggcgtcaacctgtccggcgaggccgccgtgatctcgttcaacgcggtcgccaccgccgacacgtcgcacggcgagccgatggtcgtcacttccaccggcacccaggtcaaggtctccccgttcgcctcctacccggccaagggccgggccaccggcggcgtccgcgtccagcgcttcctcaagggcgaaaccgccctgacggtcgcctgggtcggtccccgccccgccggctgcagcaccaccggcgacccggtcgaactccccgaaccggacgcccgccgcgacggctccggcgccgcggttctgatgggcccccagctcatcggccaccacatcgaacgcgactgaccgcaagcgctcaccgaaccgcccgccggcctcccccggcgggcggttcgcgttccgccccccggtggcggccgttgctccaccgcgccggtgccttcggcgcgacgctgcggcgcatcagggtgtggtgatgaaggcaggcgcggtgcccgtcctggtccgccgatgccgcgcgacccgggcatcggcttcgatggtgtcgaggtcgtcgggctggaggtcgctggtgggggccggggtgaccagcagggcacagcccagccgggggatttcctcgtgggctgcggccgggggtggtgatcggcggtggcatgcgtcggtcaccaggtggggcggatgcgcccgggggtggtgatcggcggtggcatgcgtcggtcaccaggtggggcggatgcggccgggggtggtgagctgggcgagggccgagcggacggtggcgaggtgggccgggcccagcgtgtcggcccagggttggagggcctcggtggcggcctcgtcggccgctcgggtgcaggcccagccgcggggggtgagggtaaggaggcgggcgcgggcgtcccgagggtgggggtggcgctcgacgtagcccttgcggaccagttcgtcggccatctggctggcggcctgcttggtgacgcccaggtgctcggccagctcgatgacggtggcgccgtccggagccaggcggacgaaggcgaagccgtgcgccgggcgcaggtccgtgaagccgcgggcgcggactccctcgttgatgctgtcgaccagggtggtggccgcgccgagcagcagcaccggcaggtccaggagatcacgtcgcacggaacgagtttgacatggcggtcaagttgcttgactatttggtcaagcaggttgactaattttcaggggaggaacgtcatgggaatccatcgccgggatgaaggcgtggaacatcgtctgcacggctcggtcttccggtcctacgtgtcgccgggcagtgggagcgcggagctctgcgcctggcggctgcagatcgccgggggcacggccggggcgcggcaccgggtggatcgcgaggaggtgttcctggtgctggccgggcggcttcaggtctttctggacggcgtggtcgaggagatcggggccggagacgtgctgcgggtgccggtgggcgtggagttcggcgtcgacaacgtgggtgccgagaccgccgaggcctgggtcaccacgagcgtggggctgaaggccacgatggcggacggctcggtgatcagcccgccctgggtccgctgagggcggtggccgcccggctcggacggtggccgcccggcacgggcgaccaccgttaggagccgagccggccgggaagcgggccgcggctggagtgcggcccgtgggagccggccgggaagcgggcgcggctggcgtgccgtccgcggaagccggccgggggagtcaggggcgcagggcctggatggtggtgagctcggcgggggtgagcgggcccgcggcctcggcggccaggcattcggccagttcggtgcggttcttgacgccgaggatcaccgtggacacgcccgggacggtcagggcgtagcggtgggccagggcggccggggtcgcgccccattccgcggccagcttgcggaacggttcggcggcggcgaagtctgacgcgaccggggaggcggacggcaccgtacggtcaagggaggaggtcaatgcgccggccgcgaccgcgcggatggccatgacctcgaccccgttgtcgttcgcggagcggacgatggcgtcgctgcggggtgcgacgccgggaaagtaccagtcggcgttgaggtcgagggcgttgacgacgacctgggcgacgtccgggcgcggggtgtcgccgagtacggtgatcacctggtcggggtggcccaccgcggtgatgccccaggcccggatcagaccttcgtcacggagccggaggaactcgccggcggcctcgagatagccgtcccggccgatcgtgcccggcgcgggaacggcggtccgcagctgggtgtgcaggaagaagacgtccaggtggtcgcggccgatccgccgcaggctgtcggtcaggctgcggcggatccgggcggcgaagtcccgttcggtgtcgtccggcagacccaccttggaggtgaccaggacgtccgggtgggagctggagcggatggcctcgccggccacccgctcggcttcgaagtcggcgccgtaggacggtgccacgtccagcatggtgatgccggcgtcgagggcggcgtgcacggtggccaccgcctcgcgccgatcggtcggcccccagacggcgccgataccgccgccgccgagggtgagcgcgctgatctggccgagacgcccgaagtcgcgtagttccatgaaaccgacgctaagacctggagcgcactccagatcaagcgcgcaacgaaggaatcaagcgccgcaacggaggaaccaggcgccgcaacggaggaacgaggcgccgcaacggaggtaccaggcgcgtggcgaagggatcaggcgcccggcgaaggaagcgcgcgccggaaaggaatcaggcgcgcggcgaccggatcacttgctcggcggcggcacctcgcacttgatcttcgggttgacgcccagccagttgagcgggccggcgatgacggtgacgatgacggtgccggctttcgcgcagctcgcgtcgccggtgtccttgaaatagttccgctcgaacgccgcgaccaggccgagcagtagccagatgacgatgatgaccgcgcctgcacgcatgtgagagcctcctagaccgcagggatgcgcgccagatacccggaaccgttcgatctctaaacgggacggcgggcctgcagggtgtacgtgtgcggcagccgctcgggtcgttcggtcagctgccactcgccgccgtcgagccgacgcatccggcggggcagcgcattccacggcacgctgcggtgttcgaccagtccggtcagggtgagcccggcgtcgaggaccgcgctgacgatctcgccgagcccgtggttccactcgtgcgtcacggtgtgcacgaaccggtggtcggtggcgacgtaggtgcccggttcgtcgtacaccaggggctcggtctgttcgaagtacggttcgacgatggcgagcacgtcgtcctcgcggtcgtagtcgagggtccacagcatcgggtggccctcgcgcaggaacagccgcccgccgggcaccagcaaggaggccacagtggacgcccagcgtcggatgtcgggcagccagccgagcgcgccgatcccggtgtagacgaggtcgaacccgccgccgagcgcgtcccgcgccgagtacacgtcgctctgcacgtagtcgatgtccgcgtgcgccgcggtggccagggcgcgggcgtgccgcagcgattcgccggagaagtcgagaccggtcatccgggcgccgcgacgggacagcgagagcgtgtcggtgccgatgtggcactgcaggtgcacgccccgctgcccggtgatgtcgccgagcagcgggaggtcgaagcgcaccacgtcactcaggtgcgccgggtcgcggacgaggtcggcgacccggtagtcgggcgactcggcgtgcggggtggcccgctcgtcccagttcgcccggttgatcgtcagatagtcggtcacgcgccggagcgtatgcggtcccggaaccacagcgcactctgtttcggcgtccgccgctgggtcgcgtagtcgaccgcgaccaggccgaagcgccgctgatagccttccgcccactcgaagttgtccagcagggaccaggcgaaatagccgcgtacgtcggcaccgcgcgcccgcgccgcgagggtggccgcgatgtgcgactccagatacgccgtccgttcctgatcagcgacgaatccgtccgggccgggcacgtcgtcgtagaccgcgccgttctcggtgaccgccagcgccagcccgtattcgtggtgcaggcgcagcagcagcgtggtgaaccggtccggggtgaccgcccagcccatcgcggtcttcggcacgtccggggtgatctcccggacgatcgggtggccgtccgcgtcgtgcgtgttgccgtcctcgtcgcggccggcgaagtcctgtccgaagtagtagttgacgccgagcacgtccggtttccggccgatgatccgcaggtcgccgtcgcggatcggcagggtgtgcccgcgcgccgcgaggtcggccagcagatcgtccgggtagcggccgaagaccagcgggtccaggaagatccgattggcgccggcgtcggcgcgccgggccgccgcgacgtcgagcgggtcgtccgaggcgggggtggcggtgcccaggttcagcgcgatcccgaccgtgttgtcgggtcttttcaggacttcgtacgccaggccgtgcgcgagcaacaggtggtgggtggcgtccagggcggcgccgtagtcgcgtcgccccggggcgtgcacgccgtgctggtagccgaggtaggccacgcaccacggctcgttgatcgtctgccagtcgcggacccggtcgccgaggcggtcgaggaccagaccggcgaaatcggcgaggcggtacgccgtgtcccggtgcggccatccaccggcgtcctcgagctcctgcggcaggtcccagtggtagagcgtgacccacgggtcgatgccgttcgccagcagctcgtccaccagccggtcgtagaaggacaggccggcctggttggccgggccgcgcccgcccggctgcacccgcggccaggagatcgagaagcggtaggcgtcgacgccgaggcttttgatcagctgtacgtcgtcgggcatccgatggtagtggtcgcaggcgacgtcaccgtgctcgccgacgacccggtggctgaaggtgtcccagatggacggtgtgcggccgtcctcggcggcggcgccctcgatctggtaggccgaggtggccacgccccagatgaatgtcacgaaatatcccccatagtgagaagaaaaagtggcggccggccccgacggcagggggccggccgcctgtccctaaccgaccggctgctcggtggggtgcagccagcacgccaccgatcgggtcgatccgtcggcggtgtccggccggccgagcaccgggatgttcccggcgcacgggtcgaacgcccgggggcagcgggggtggaacgagcacccggtcggcatccccttcaggtccggcggcgaaccgggaatcccggtcagctcccggcgcgggccgcgcagcgccgggaacgagccgagcaggcccttcgagtacgggtgcagcgagtctcggtagatcgccgccgccggcgcctcctcgacgatccggccgccgtacatgatcgcgatccggttcgagaactcgaccagcagcgacaggtcgtgggtgatgaagatgaccgagaagcccagccgttcccgcagctcgatcagctggccgaggatctgccgctgcatcaccacgtcgagcgcggtggtcggctcatccatgatcacgacctgtggctgcaggatcagcgccatgccgatcatgacgcgctgccgcatgccgccggagagctgatgcgggtacgcatccatccggtccgccgcgatcccgaccagcttgagcatctcccgggcgcgggcgttgcgctgcgtctcggtcatctccggccggtgcgcccgcagcacgtcggtgagctgggtggagatcttgtgcaccgggttcagcgagttcatcgcgccctggaacacgatcgccgtctccgaccagcggaagccgcgcaggtcccggtcggagaggccgagcacgtcgaacgcctcgccctgctcggggtggtagatcacctgaccgccggtgatcacgccgggcggcggcagcagccgggtcatcccgtacgccagggtggacttgcccgagccgctctcgccggccagcccgagcacctcaccgcggtgcagggtcaggttgacgtcgcgcaccgcgcggacggcctggtcgcccagcccgtacccgacattcaggttcttgatctcaagcaccggctcgttcacggggtgacctccgtccgcacgacaggcgtggggctggcgtgggtgatcggctccggcgtgtggctgagcacgggggtgaaaccgatgcgcatccgaaccgtacggccgtcgattgtcttgatcttggttttgccggcgctgcgcaggcggggactgacgaactcgtcgatcccgaagttgatcagcgacagcgaggtgccgagcagcgcgatcgccagaccggccgggatgaaccaccaccaggcctgctgggcgagcgcctgctgaccctgcgcccagaacaggatggtgccccagttccaggtgctgctggaggtgacgccgatgaaggccagggtgatctcggagagcaccgcgaagatgaccgtgccgacgaagccggaggcgatcaccgcggtcaggttcggcatcagctcgaagacgatcacccgccaggtcttctcaccggtggcccgggccgcgtcgacgaagtcccggcggcgcagcgacagcgtctgcgcgcgcagcacccgggcgttccaggaccacgaggtcaggccgatgaccagcgcgatcagccagtcctcggcgttgttcagggtggacgtgatgatgatgatcagcggcagcgccgggatcaccaggaacacgttggacagcgccgagaggccctcgtcggtcttgccgcccaggtaaccggcggtcaccccgatcagcaccgacagcacggtggcgatgatgccggccaggaagccgacgaacatcacgctgcgggtgcccaccaggagctggctgaagacgtcctggccgaggtgcgtggtgcccagccagtgcgcgccggacggcggcttgaccaggtcgttgctgcgggcgtccggtgagtacggcgcgacccacggtccgatgaccgcgaacagcgcgtagatcgcgatcacgaccaggccggtggcggccttcttgttgctgacgaagcggaaccgctgacgcctggccttggccggcctgtcggtctccggctgcgccatcgagccctgaccgggaatgacctgctcgatgctggaggtggggatcgtcacgggtcagccctccttgcgggtgcgcgggtcgaggagcaggtacgcgacgtccgcgagcaggttcgccaccagcaccgagatcgtgatgatcaggaagatgccctgcatcagcgggtagtccgaggcgcccagcgcctggaagagctcgaagccgacacccgggtaggagaagacgatctccacgagcagcgtgccgccgacgatgaagccgagcgacagcgcgaacccggagacgttcggcagcagcgcgttgcgggccgcgtagctcaacgccacccggcggtcggagagccccttggcgtgcgccacggtgatgtagtcctcactggacaccgtcaccatcatgttgcgcatgctcaggatccagccgctgaccgaggagatcaggatggtcagcgccggcagcaggctgtgccgcagcgcactcgggatgaagtactggtcgaacgccggcaccaggccgttgtcgaagccgccggacgacgggaagaagctgtccggcccggtgagcaggtagatcgcgatgatgccgagccagaagtacggcaccgaggagaggaacgtggtcaccggcagcaggccgtccgcccacgagccgcgccgccagccggccagcacgcccagcccggtgccgaggaagaagctgatcaccgtggtgatgccgaccagcatcagggtccacggcaggctggtcttgatgatctcggagaccggggtcgggaagaaggcgaacgacaggcccaggtcgccgtggaacagctgcacccagtagtcgacgtactgcgaccagaggctcttggtcttgtccagcccgaaaaggacgtacagcgactgggtggcctgcgagctgatctggccctgataccgggcgatcagcgcctgcaccgggtcgcccgggatcagccgcgggatgaagaagttcagggtgatcgcggcccacgccgtgaagaggtagaacgcgatgcgctggagcaggtatttcacttcgacacctcgtcgcggtcgtacagccagcaggccgcccagtggccgggcgcgtcgccgatctccaggggcaccggcaggtcggtgcggcaccgcggcatcgcggccgggcagcgcgggtggaaccggcagccggtcggcgggtggatcaggctcggcggctcaccgttgccggcatcctcgccttcggcttcggagatgccggtcagccggtccgggtccggcgcggagtggatcagcaatttggtgtacgggtgtgccggcgactgggtgacggtctcgctgtcaccaccctcgaccatccgcccggcgtacatcaccatcgtctcgtcggcgaagtagcgggccgaggcgatgtcgtgggtgatgtacaggatcgccaggttgagccggtcacgcaggtcgcgcagcaggttgaggacaccgagccggatcgacacgtccaacatggacaccggctcgtcggcgagcagcgcctcgggctgcgcgcccagcgcccgggcgatcgccacgcgctgccgctgaccgccggagagctcgtgcgggaacttgtccagataccgttccggcggggtcagctgcacccgctccagcaggtcgtgcagcgcctggtccagatccgtcgcggtccggccggcgttgccgtggatcttcagcgaccgggtcaggtggtaccggatggtgtgcgtcgggttcagcgacgcgaacgggtcctggaagatcatctggacccgggagcagtaccggcggaacgccgacccgcccctgaccttcgtcgtctcgccgtgtagccggatgtcgccaccggtgcgcgggtagagctgggcgagcagccgggcgatggtggacttgcccgagccggactcgccgaccagggccaccaccttcccccggcgcagcgtgaggttcacgtcatcgacggcgtgcaccgcgtccttgcggttcgagaacaggtcgcgcagcttccggcggacggggaagtgcttggtcaggctgatcgcctcaagcaccacctcgccggccggcgctttcgcgtcggggatcgacgtcatgccggtgtccttttgaagcagcgagcagggaagacgggcgccccggggatgagccggggcgcccgtgtcagacgatcaggagttggcgggcttgaggtgcatgatcacgtcgagcgcgccggactgggtgggctgcagcggggcgtactggtccgcctccgagggccagccgacccagttcttggtgctgatcgcgccgccgacgttgtccgagccgatcggcagcatcggggcctgctccacgaagatcttctggagcgtcgcgagcgcggtggtgcggtccgcgtcactggtcgcgttggcgtacgccttgagcgcggcggtcgcctccgggctcttgaaccggccgaagttgccctgctgggccagctcgccgatcggcttgagcaggtcgccgtccatcaccgtctggtagatgtcgaacggcgtcgagccaccgttggtccagcgcatgacgccgccgaagtcacccttctgcacgttctggtcccagacgttctggttcggcttctcgaccgtggcggcgatgccgatctcggccaggttgcccttgatgatctccagcgtggtctggtagtccgaccacggcgccgggtcgctgagcttgatggtgaccggcttgccgctcttgtccttcagcgtggtgccgtccagcttgtagccggccccggcgagcagcgtcttggcgccttcgacgtcgaccttcaggtcctggcccttgtacgcgtcggtgatgaaagcgtcaccggcgccggacggcaggcccgtgatgctcttcagctccgggtggaagtagccggcctcggcctggttgaagatgtcggcccggttgatcaccatgttcatcgcctggcgcagcttcgggtcgtcgaacggcgccctggtggtgttgatgtagaggccgtggatgcccagcacgcccggcgcccacaccttgaagtgctgcgggtccttggcgacgaaggtctgctggtagttcgggatgaacacgaagctccactcggactggccggtggccagcgcggtggtctgcgcgttgttgtcggtgtaggacgtgtagcgcagctccttgacggccggcgggctctgccagtaaccgctctcccgacgctcaagaacgatgccctgctggctgaacgtcttgagggtgtacggaccggagccgaccggttccttgatcgggtccttggccgggtccgcgatcttctcccagacgtgcttcgggacgatcgggatctgactgatgatcttgtgccaggtggtgaactgcgaggtcttgaaggcgatcgtgaccttgttgccgttcggggtgatctggtccagcggcagcgcgaagatgttcagcgcctcgttcgacttgatcagattgaacgtgtacgccacgtcctcggcggtcagcttctgcccgtccgaccaggtggcgttgtcccggatggtgacatccagctgcttgtagtccggcgcccacttgatgtcgctggccagccacggcttggcgggctcggccggcttgacgttgttccacatgccgaggggctcgtagatggtccagcggtagcccagcgaggcggcggccgaggtgccgaggaacgggttgttgctctcggtcacggtgccgttcggcatgccgatcgacaggaagtcggcgcccttgctgttgctggcgttcttgttgttgttcggcgagtcaccacaggcggccacgccgccggtggcgagcacgcccgccagggcgaccgcgaacagcttccttctctgcatcggagaatctcctcggattggcggaattcggggtgagaggggtgcccggagggcgtgcgccatcgcgtgaccggcggatgccggccccgaggtgcgcggggtcgcccggccggccggggccggtcgaacgggagtgcttcgttatcggtgggcgctagggcttggctcttgtcgaggaccgggccacgaacgtcgccgggatcaccgtcggccggttcggcagcgcggtgccctcgaagtgggcgagcagcgtgcgggccgccgcctcgcccatctcgcgcatcggctgatgcacggtcgacagtggaggctgatggtgggccgccatcgggatgtcgtcgaagccgaccaccgcgacgtcctccggcacccgccggccggcgtcctggatggcctgcacggcgccgaaggcggacaggtcgttgtggcagaagacggcgtcgaagtcgagtccggcgtcgaacgcccgcttgaccgcgtcggcgccgcaggccaccgtgaagtcgccggtgaccacgcagtgttccggaatcgggtggccggcctcggcgtagaccgtggcgaagccgtcggtgcgctgcacggtgcacccgaaccgggacgggccggtgatcagcagcggcttgtggcgcccgatctccagcaggtgccgggccgcgtcggccgccccgctgtggttggtggtgccgacggtcgggatctggccgccggagatctggtcacggtcgtcgatcagcaccatcggcaggccgcggctgtgcagggtggcgagatagctcagggtgccctccggctcgatcgccagcaggccgtcgaacgacttggcggcgacctgggcggcgaactgccgcatcgactcgtcgccgcggttgaaggtgaacagcagcaggccgtactcctcggactccagcacgtcgaccgcgccctgcagcacctcacccatccagggccaggtcagcgagggcaccagcatgccgatcacccgggtgcgtccgcgagccaggttgaccgcgcgggcgctggggacgtagccgagctcctcgatcaccgcacggacccgcgcggcggtcgactcgtccagctcacccttgccgttgagaacccgggacacggtcgtcttgctgaccttcgcccgggccgccacgtcggcgatggtgatcggcacaagttcctccgaggttggtaaccagcgtgttgcaccggggttcggaaccggtttcggtaccggtttcggagtcaaccgcagtgagggctgtcacgtcaatgtgccgggggatcaaattaggtttcgttccggtaaccagggcgcttcgggttcgttcagcgaggcaacaatcggtacgtttcggtctccgcggccaggttcggcagcaccacgccgagcggcgcgtcgatcaccagatccgcgtacggctcgccgcgggtcaccccccggttcacgatcgccacccgcaccccctgcttcaccgcgcgcagcacgaaccggcgccccgacatcacggtcagcgaagaacccagcaccagcagcgtgcgggcgccggcgaccagctcgaacgcccgggacacccgttccggcggcaccgtctcgccgaaatagaccacgtccggcttcagcaggccaccacacgccaggcagtcgaccggggtgaacccgtccagcgcggcgtcgtccagctcggcgtcgccgtccgcgttcaccgccgaggcgaccacggcgaaattcgggttcgccgccgacaaccgggccgccagctcggtccgcggggtcagcgcgccgcaggccaggcaggtgatccgggccagattgccgtgcaactccaccacgtcccgggcgccggccgcctgatgcaggccgtccacgttctgcgtgatcaccccgtgcagcaggccgcgctcctgccagcgggccaccgcccgatgaccgtcgttcggccgagccagaccgatcgtgtgccagcccagatgactgcgcgcccagtaccgccggcgggccagcggatcgccggtgaacgtctgataggtcatcggggtgttgcgccgggccgagccggacgggccccggtaatccgggatgccggagtcggtggacaggcccgccccgctcagcaccaccacgccaccgtcgccgagccagccgtcgagccgggccacctgctccaccaaaccgaggtccatgacacccatcgtccctcgtcgggatgaccggatgtgacctccatccggtggccgtgaccgaaacgaccggtgcgcgttgccggtcaccccggtaggttgatcagtgtgaccgctgtggcgcgtggggccgaccgttcgtgggacggtcgccgcctgctgcggttcctcaccagcctggcggttctcgccctggcggtgacgctgcgcctgccgttcggcggcccggtcgccgggcctgtcggcgggttttcggccgcgccttccgtcgggtcttccgtcgggtcttcggccgcgcctaccgcggggtcctccgccgcaccggcggcgtcagccgccacctcggacgcggctccggcggcggtgccgccggcggcaccggttgccgccgctagctagctagtcgtcccgcccaccggcaccctcccggccggggtcgtcccggccaccggcgactcccgggcacccccgacccgctgaccgattctcatcgttcggcccgtcgatcccttttgcccgtgggggtgttccgtggattccgccttcctgaattccgtcccgcaagccgtcgcgatctggctgatcatcgtgttgctgctcgccgtcgccgcggccaccgtctcggtgccccgcgtgctcaccgagcccgctccggacgtcaccgaccgcgagcggtacgccggcgaggtggccatcgcggccggccgcgcccgggcgaccgccgaccggcgccgtgccgactggcaggccgcccagcaggccgtcgacgacgcctgggcggcgtacgagaaagccgaccgggtcgcccggcggatcgccgcggccggggtgtacccgctgctcgaccgccgccgcaaacccggcgagaacgtcgaccgggaacgcttcctgcaccgcgcggccagcgagctctgccgcagccaggacctctccatcgaccagctcaacgacgtcttcgcgcaccgcggctggaacccgcggctgcatccggtccagcaggaatgggtgctggcccaggcggtccgggccaaccggctgaccggctaccgggaggcggtcgagcgggaacgcgccgcctggcggtccgccgacgccgccgccgaggcgctgcgcgggctgcgcgccgaggcgatggccgctccgctgctggtcgacgtgccggaaccggccgaccagcagtggtggaccgagcagtggacgaccgccgatctgccggcgagcgccgcaccggcctaactggaccgggccgcagccgcccggcccggcccgggtccggccgaccccggccggacccggctcacattggcgagcggcttgtcgtacccgcccggtaacgtttggcgcggcgggtggcaggcgggacggcgaggaggagatggtggcggcgacaccggcggagacgtccgcggccgtggcgcggatgcaccgggcggccctggtcgaggacgccgtgcacgagatcatcgagcgcggcctgcgcaaccgtgggtggaagccgtacatcacggcctacaccggttacggcgcgcccggctgggcccgggtgatggcccgggtgctgctctcccggccccgcctggtccggcggaaacgggagaaggtgcgcggctggcgcagcttcaccaccaccccggtcagcggcgccacggtgcgcatcgaggtgggcggcagcgtcaccgagacccgcaccgaccgcagcggctacatcgactgccgggtcaagggcgacctcgcgcccggctgggccagcgtccgcatccactgcgagggcggggccccggtcgacgcgccgatccgggtgatcgacccggccgtgaagttcggcctggtctccgacatcgacgacacggtgatggtcaccgccctgccccggccgctgctcgccgcatggaacacgttcgtcctcgacgagcacgcgcggatggcggtgcccggcatggcggtgctctacgagcggctgatcaacgccaacccgggcgccccggtgatctacctctccaccggggcgtggaacgtcgcgcccacgctgacccggttcctgagccggcacctctaccccgcgggtccgattctgctcaccgactgggggcccacggccgaccgctggttccgcagcggtcaggagcacaagcgcaccacgctgcgccgcctcgccgacgagttccccggcgtcagatggctgctggtcggcgacgacggtcagcacgaccaggagatctactccgagttcgcccgcgagcacccggacaacgtggcggccgtcgccatccggcggctgtcaccgacccaggcggtgctggccggcgcggtgcccgggccgaccgagaccccggaggcggtgccgtccgggggcaagacgtggttcgccgccccggacggcgccggcctctggtccctgctccgcgacacggacctgaccaagtgaccggcgccgcgccgtccgcgccccgccggaccccgtcgtcccggccgctgggtggctattccgcctcggcgggcggggtggacacctcggccacccggctgtgcagccggctccgaatctcgtccggggtgtacgcgcgtcgttggcgctccgcccgggcgatcaccaccccggtcgccgcgactcccgccagccccgccagtcccgctaccttccaccaacgcatctgctgagaatagacacgtggttgccgacatcagcctcgacgaggccattgaactgacccgcacgggcgacatctggatcttccggggccggtccgggcccgaccgtgccattcagaccctcaccaacagcccggtgaaccatgtcgggatgtccctggtgatcgaggacatgccgccactgatgtggcacgccgagctcggcaggagcctgcccgacatgtggtccggcaccttccaacgcggcgtccagctgcacgacctgcgcgacgcggtcaccgtctgggcccgccgctacggccagcggggctggctgcgccagctggagccgggcgtcacccgcgccatggaggacaaagccctcaaaacggtcgcgcgcctggacggcaccccgtttccgtccacctcccagctcgcctggcgctgggtccgcggccgggtcccgcagatccagccgccgtggaaaccggcgaagaccgacgccaccctggagcgcgcctactgcgccgaggtggtcgcggtcacctacgaggacatgggtctgctgccccgcaaccacaaggccaactggtacgacccgggccgcttctggtccggggacgagctcgaactcaccgcgggctacctgctgggcgacgagatctccgttcgggtccccgacgcctgaccgcctcgcgccgttcggctcgcgctggccgcctcgcacccttcggctccgcgctgaccgcctcatgcggccaggctccgcgctgacccggctccgcgccgacctgccccgcgccgcacgactctgcgccgcccggccttgcgccgtacgccgcaccgcgccgttcggcctcacgccgtgcggcgcgggcgacgacgacgctcggcctggcgggttctgcctgcgccgcgcggcccggtgtcgtcgtgcatgctgtcgggccgcgcggggccgggtggcggctcgccggtttcgcgtcggcgacggcagcgtgcggatttcgctgttccgtcggggcctgccgcggtaggccggcggagcgctccatccacacgcttcggtgtgcttcgatccgtcaactgtgctggtgaaatggccggtcactattttttcgtgtgattcgcgccacgtatttgagatgatctcatgcaattgccggtcggctccggagtggcccgaatggcgcgacgaactggcgcggttgcggccggagctgtggccgttcgactcatccatggcggttccggaacggttccggaacgctgtcgaagcattgactcgacgtttacgggtctgaaagactcggagtgcaacggggtcagggcggcctatcgtgttccgccggtgacgatcgcgccgatggtgatccgcttatcgcgaaaacgaattcctggacattgtctgtgtggaccgagtcctcgatcgggctgtccgcaatctatcgtcgccgacttggcagcaaatgcaataccgttgcctcgcgggcggcgggcgtgcggtcatttcaggcaagcccatgaggcgcgtattgcccgttgttcctggtaggcgggttattcctaacgcagggcgctagacgagttccggaaccacattgatgttgaaccatgggatttgtggctgaaatgctcggtccgggccgcagtcaaaggctcatggcaaggaatggtcgatcgcttgacgcggtccaaccggaagggttcaggaaaatgatgaagaccgtacggggacgggcgacccgcgtggccgctgccgctgttgtggctaccgcggcgctggccgcgccgcagctcagcagcccggcatcggcggcgggttgcagcggcaccttcattctctacacggggttcaactacacgggcaattcgcagtactacagcactccggtcaacaacctgacgctgaaccggaatgtcgcgtcgatccgcaactactcgccgtgcaccctcacgctgaagacggacaacggcacctaccgggtcgtcggcaacggcggaatctcggccctcggccgctacgtttacaccatcaccaactgaccgattaaggaaatgtggcccaccgaacgagatgggccacattcctgtgcgccgtggcttgtcggcgtggccggggtccgacgccggtcgctgccgcccggcgtttcgccgggccgcggctcggccgcatggtgagtcaccgagagccgcggcgtcccgctgcacccggtgagctgggtgcgccgcgctaccaatgcacaccgcccgccgggaagcccggcgggcggtcaggtgggcgcgggcggggtggtcggcggccgtcgatggggcggccggccggcggagattcggtgggcgcgggcggggtggtcggcggccgtcgatggggcggccggccggcgcagactcggtgagcgccggtggggtggtcagcgcccgccgggaaatatccggcgggcgctcgatgagccccttgttgcgtgctcagcggccgccgcggcggcctgtgctgcgggccgagaaggccgcggcgccgccgcccggagcggctagctagctagggcccgcgccggccgtgccggaccgggcggcggatgcggtgcccgacccggcggcggaagcgttaccggtggcggcgggtcggcgacccccgcggcggcggccggaacggccggtgccggccggtgccgcaccgtcgagatccacgtccgggacggcggcgccgggctggtgctggcccggggtgacgaaggtgcgttctcccggggccagctcggacagcagtgcgtcgccggggcgggcacggcgggtcagcggacggatgccggccttgcgggtcaggtcgcggacgtcggcctgctggtcgtcggtcatcagggtgatgaccgtgccgcgggcgccggcccgggcggtgcggccggaccggtgcaggtacgccttgtgctcgaccggcgggtcggcgtggatgaccagggcgacgtcgtcgacgtggatgccacgggcggcgatgtcggtggcgaccagggtgggcgcggagccctcggagaacgccgacaggttgcggttgcgggcgttctgcgccaggttgccgtgcagctcgacggccgggacgccggccgagatcagctggcgggtgagcaccttggcccggcgcttcgtccgggtgaagacgaccgagcggccgggcgcggccagcaggtcgaccagcacgccgaaccggtcgtcgggctggacgtgcaggacgtggtggtccatctcgaccggggcctgcgcggccgcgtcgacgtggtgcgtgaccggttttcgcatgaactgcttgaccagcacgtcgatgccgttgtccagggtcgccgagaacagcagccgctggccgccggccggggtctggccgagcagccgccgaacgaccggcaggaagcccaggtcggccatgtggtcggcctcgtccagcacggtgatctcgacggcgtcgagcgaggcgtgcccgttacggatgtggtcgtcgaggcggcccgggcaggcgaccagcacgtcgacacccttgcgcagggcggcgatctgcgggttcgccccgaccccgccgaagacggtcagggtgcgcagacccatcgcgtcggccagcgggcgcagggtggcctcgatctgggtggccagctcccgggtgggcgccaggatcagcgcgcgggggcggcccggcctcgggcgtgtcggggcggccgccaggcgggcgacgaccggcagcacgaaggcatacgtcttgcccgatccggtgcggccgcggccgagcaggtcgcgcccggcgagtgagtcgggcagcgtggccgcctggatcgggaacggtgtggtgatgccgagctcggcgagggcgccggtcagaacggcggggacgcctagctcgatgaacgatgtcattaagtgggtaactctccgtaggtcagctggagatcaatcctactggtcaccgacggcaaccttcctgcacccggtatcgaaccaggccgcactcagcctcgcagatctttttcctcagcgccggacgcccccactccggccggtactgaggagacccctgatgaacggtgaggcacctgccgtcgatcggcgtcgcgaggacatcgtgcgggcgaacatgcccctcgtcggccacctggtccgcgagatgctggcccgggtccccgcccacgtcaaccgtgatgacctgctgtccgcgggctacgccgccctggtcgccgccgcccgcgggttcgacccggagcggggtgtgccgttcccgcggttcgccgcggcccgggtgcgcggcgccctgctggacgagttgcgcgggctggactgggcgagccgttcggtgcgccagcgggcccggcgggccgatgcggcccgggaggagctgaccgccgaactcggccgcatccccaccccgcaggagctggccgaacggctgggctgcacggtcgaggacatcgagcacggcaacgacgacgtgcaccgggcgacggtgttcagcctgcagggcttcgccaccgcgaccgccgacgacctggtgaccgaacgcactcccgggccggaggagatgctgatcctgcgcgagcggctcggctacctgcggcacgcggtggacgccctgccggaccgcctgcgggtggtggtccagggctacttcttcgacgagcggccgatgtccgacatcgccgccgatctgggagtcagcgagtcccgggtgtcgcagttgcgggccgaggccctggtgctgctccgggacgggctgaacacccacctcgatccggcgatcgccgcgcagaccccgccgaaggagggctgtgtggcccggcggcgggcggcgtactacgaccggatcgccagccgcggcacgctgcgcagccgcctcgcgatgaccggcccggacggcctgccggtcccggcagccgcctgacagacccgaacggtgggatgggcccgtcgcggttcgcggcgggcccaaaaaccttactggttgttggcgcaggtgccggccttcttctgggcggcgatcgccttggccgcgcccatcttgtacagcgccagcccctccgcggccggctccagccgccacccgttgccctcgtagaccatggtgtacgactgcgccgccaccagctgcttcgcgatcacgatcgccttgtccacgccctccatccgcgcgctggtcagggtgatcgccagccccttgcgggaacaggcctggttgagcttgacgtagtcgtccttgctgatcgcctgcttgccggcgctggtgtacatctcccaggcgccggcgaagtcgccaccgctgaaccggtcgaacacggtctgcgcggcggccttcgccccgtcgagggttttcggctcggggccaccggcggcggccgcggcggcgttgccggccggggcgtcatcgccgccggagcaggcggaggtgacgccgagggtggcgacggcggccagggcgaggacagtgatgcgacggtacggggtgttgaagtccatgccccggttaaaggcgccacgcggtcccgcgtaacggctcccggcgtgtcctgacaccttccggacacttgccgcccggaccgtaacctcagcccgctcggctattctggtcgtttgccgtaaacagaaaaggcaaccacgaaaatggttgccagcggccggaatgatagcacgaaaaggggcgattttgtcaagctctagcgccgatttcgatgctgagcaggcttacctgaccgagctgtaccagcgcctcgatcagctgcgtgagcaggccgacagccggctcaagggcattctgctggaggccggtggcaccccgcaggggcggacccagcgcgaggccacccgggcccactacacggagcagctcgcccagatgaattccgtcgagaacggtctctgtttcggccgactcgacttcgccgccggcgacccccggtacatcggccggatcgggctgttcgccgaggaccgcgaccaggatccgctgctggtcgactggcgcgccgcggccgcccgcccgttctacctggccaccgcggtccagccggacggggtcacccggcgccggcatctgcgcacccgcggccgcaccctgaccggcgtcgacgacgaggtgctcgatctcgcggccggtgacgggaccggccgggaggacgtcaccggtgaggccgcgctgctctccgcgctgaccgcgaaccgcaccggccggatgcgcgacatcgtcgagaccatccaggccgagcaggacgaggtgatccgctccgggctgcccggcgtgctggtggtccagggcggccccggcaccggcaagaccgcggtggcgctgcaccgcgcggcgtacctgctgtacacgtaccgccagcaattgactcgcagcggcgtgctgatcctcggaccgaacaccaccttcctgcgctacatctcccaggtgctgccctcgctggccgagaccggggtgctgctggccacactcggcgacatgttccccggggtgcgggcccgggccaccgaaccggacgaggtggccgcactcaagggcgacctcggcctgatgctgcccgccctggagaacgcggtcgccgaccggcagacggtgccggacgacttcgtcgaggtcgaccacgacgggtatccgctgcggatcgagcgcgcggtgctggaggacgcgcgctcggcggcccgccggtcgggacgcccgcacaacgtggcccgggcggtcttcgtgaccgaggcgatccaccagctgtccctgcagatcgccgagcggatcggcgccgacccgctgggcggcgacaatctgctctccgaggccgacctggcggagacccgacgggagctgcgcgaggacatcgacgtgcagcagctgctgttcgacttctggccggtgctgaccccgcggcaggtgctgcgcgacctgctgaccgatgctgatcggctggagtcggccgggctgccgaccgtgctgctgcgcgacccctcggccgggtggacgccggccgacgtgccgctgctcgatgagctggccgagctgctcggggtcgacgacacgctgaagaagcgggagcaggagcgacagcgcgaggcggcgatcgagtacgccgagggcgtgctggagatcgtcgagggctcccggtcgctggacttcgaggacgtcgaggaggagatcctctccgcggtcgacgtggtggacgccagcgcgttcgtcgaacggcacgaggtgatcgacacccggaccgcggccgagcgggccgccgccgaccgcacctgggtgttcgggcacgtcatcgtcgacgaggcgcaggagctgtcgccgatggcctggcggctgctgatgcgccgctgcccgagccggtcgatgaccgtggtcggcgacgtggcacagacctccgagccggccggcagcacctcctgggagcaggtcttggagccctacgtcggccagcgctggcgcctggtcgagctgagcgtcaactaccgcaccccggccgaggtgatggcggtggccgcggacgtgctggccgcggtcggcgccggggtgcgcccgccacgctcggtccgctcgtccggggtgaccccgtgggcccgccgggtgccggtcggcggcctggtggaggaactgctggcggacgtccgcaaggaggccgccgcggtcgactccggccgggtcggcgtgctcgtcccggcccggctgaccggcccgctgggcaccgcgctggtggaggcgatcccgggcgcggctgtgggggagcagccggatctgctcaaccacgtggtgctgatgaccgtacggcaagccaagggtctggaattcgactcggtcctcgtggtctgtccggacgagatcgtcaccgagagcccgcgcggactctccgacctctacgtggcggtgaccagggcgacgcagcgcctgggggtgctgcacaccgaaccgctgcccgaggtgctctccgcgctcgcctgagcggtgcgcgggcgggccgggatcacgctgtcccggcccgccggcagaggaagacgttctccctaccgggacggtccggcgccgcacggacctccaggacctcgaaaccggtcgcccgcaacgactcctcgatctcggaccggtcgcggaagcacagcgtcgaagtcgaggtcagcaccgtctcatcggacaggaaacgatattcataccggaaggagacaaggggcagtcgtacgtcggtgagcatgaaccgtcgctccaccccgcccgcggtggcgggcggatgatcccactgctcccaggcgcggaactccggacgccgcgcctcgaaaaccagatgaccgccgggccgcaggacggcgtggatgccgcgcagcgcggccgtccagtcatcgtcggtcacgaagacctgggcgacgttgccggtcatcagcgccagatcggcgggctccggtagcggccaggcctgcggcagcccggccgcaccggtgtgcagccaggtgacccggtcggcggccggcttggtgcgggcgacgtccagcgaggccgcggcgggatccgcgccgatcaccgtgtgcccggtgccggcgagcagggtggccagggcgccggtaccgcaaccgacgtcgaggatccgggcgggccgcagggactcgatgatcgtcaggtaggcggggaggtcgtcccggtcgccgtcgaacaggtcgtagagcggggcgagccggggatcggtgaacagggcgtcagggacggagccgggtccgtcgagggaggccttgtccgacgggggattgttggtcactgccggaccgtagagcggcggttcgtgtcggcgcgaccggtttgttcacggtacgggactgttcgggctgcgggattgttcgcgctgcgggactgttcacgccgcggctttgttcgctgcgggtttgttagtgctgcgggtttgttcgcgaccctcgccggatccgtcacgggatcctgcgggtttgttcgcgctgcggggttgtccggacttcgggttgtccacactgcgggttcgtccacagggcgcgggcatgatcttgggttttccggccatgctgtcgtgggatggtccccctgggtgggcgggatttcgtcgggtgccgggcggcggccgggtccgggaccacgcacacccggcccggcgtccgtcggacgccgggccgggttcgatacctcaggcggcggtcgggcgcagcccgcggccgtgcgccgtgtgaccgtgcgcgttggtcatcgcgagacggctgcgcaggtcggtgttgctggcgatggtggcgtagtacgacgcacggcggcgggcggtgatgctctccgggttgtccggggtcggcgccagctccgggtcgaggtgcgtgttgaggccgtcgcgcagcagcgacagggcttcggcgcgcagctgcgagacgcgggactcggtgacgcccaggtccttggcgatgtccgccatcgggcgctcctgcaggaagtactcggtgaccacggtctgcaggcggtccggcagcgagccgatcgcgtggtgcaggtagccgatctgctcgcggcgcagcagcatctcctccgggcccggcgtgcgctcggtgaccaggtcgtcggcggagctggtggtgaagccctgcagcgacaggacggtggcgcgctgcacgtcggtgtcggtctggtgcagctcggaggtggtggtgccgagcgcctgcgccagctcctccggcgtgggggtgcggcccaggctggtggtcaggttctgccgggtgctgtcggtgttgcgggccttcgaccgcaccgaacgggtcgcccagtccagcgagcgcagctcgtcgagcagggcgccgcggatccgggtgccggcgaagcggtggaacggcacgccgcgctccgggtcccagccgcgggccgcggtgaccagggcgtgcaggccggcgctggtcaggtcgtcgcggtggatgtggttggggatccggctcagcatgtcccgcaccaggtggccgaccagcggcatgtgcgtgcggatcagctcctcctgctgggcggcggagagcaccggcgtggcgggagcggtgtcggcggcgaagtcggcagcggtcgtcacggtgctggtcatgtgatatcccccggttgttgtcggcgccccttggctgggtgggcaccggctgacagggagaaactttgaagccgggagggtgcgggacaaggtcacgcacaggtgcgtgccggttgcgggtgaaccgccctgccgcgttgccggtgtcgatcggcggggaccgcggccggttgagaatttttgcgacggtagggcactgtgctgcgcatggacctgagtgacagcgccgcgggcatcaacctgatcaccggcctgctggtcgccggcggggtgctcggcgtgttcctgccggtcatccccgggctgctgctgagctgggcgggcgtgctgctgtgggtgctgctgacccccaccgactccgacctgaagtgggcgatgctggcgatcgccaccgggatcacggcgctcgccatggtgatcaagtttctgtggccagcccggaaacttcgcgattcgggcgtacggtcgtcgagcctgctggccggcggtgtgctcggtgtcgtcgggttcttcgtggtgccggtggtcgggctggtgctcggcttcctgctcggcgtctacctggtggaggcgagccggctgggcggtacggcggcgtggcgcaccacccgacgggcgctggccgcggtcgggctctccctgctggtcgaactggccgcggcgctgtgcctcgcggtgatctggttcgtcggggtggtcgcgaccgcttcctgagtggtctcccgggcccccgtcacggcttccggaagcgtctgcgccggcctcgatggatcgccagcagggtcagcggcagggcggccagcaccacggcgccggtgccggccacgatcagcgaccggctgtgcgacttcaccaccggtttcgccgccgtgccggagacgccggcgctcgccttctccggcgtggcggtcagcgccgccgcctccgccggtgtgaccaggtggcccaccgaggcgccggccggctgggcgaaaccccagtcgagcagcgccgcgccctgctgccagccgcgcagcggatgcgcctcggcgcccagcagggtgaccaccaggcggcgcccgttgcgctgggcggcgcccacgtagctgtgccgggccaccgtggtgaaaccggtcttgccgcccatcgcacccgggtagttgtagatcagcttgttctcgttctgaaactggaagccgccgaccctggggctgcgctgggccggcatctgcgcgcttctggtcagcacatacttacggaagtcggccttcgcgaagtcggagcgggcgatcagggccaggtcgtacgcgctggtgaactggcccttgccgtccagaccggacggtgtcaccgcgtgcgtctggaaggcgcccagctcgcgcgctttcgcattcatcgccgccaccgtggtggccaccccgtcggcgccgccgcccccggccatccgggccagcgcgttcgccgcgtcgttgccggaattgagcagcaggcccagccagagggtggcgaccgggtaggtgccgccgaccacgatcccgaccgccgagctgttcgcctcgatgtccaggtcgctctgcacgatcttgacgttctgcttcgggtcgagccgatccatcgcggtggccgccagcagcgtcttctgcacgctggccggggtctggtagacgtgcgggccgcaggcgccgagcacctcgccggtgtccaggtcggcgacgatccaggtggtggcggtgaccgccgggggagtcgtggcgccgggcggcacgaccaggccgtgagtggccaggtcggggccgccgaccgccatgtcccgggggttgtccgccggcggaaccgggcgcgggggagcgctcggcttggcgatcctcgggtgcgggcagggcacctccgcccccgttttcgcctgctgtgccggtttcggtgcggcggccgcggggacggccgggatcgcgagcagggcggtcagggggatggtcagcagggggcggatcacggccagcgggctccggcttccagacgatgctccagcagatgctccagcggcacggtctcgccgtcaccgccgccggccccgacgatcagccgcggcatgctcggcgacaggtcggcgccgacgaaccgggcgcgcagcgaggccgggacggtgagcacgagatactccccgtcctcgccgacggcgaccgagcggttgcgcttcagataccagccgcgggcccgggtccgatacgaccagcggccgtcgtaggtggtggcgaccagcggatgcggggccagcccacgctcggcggcccggcggacgaaatcctcgagcagtgcggcggcctgctgcgcctcggcggtgcgcccggcctccagcgcggcggcccggccggccacggcccgccggtgatgcgccagccagtcggcctgctcgtcgtgcatggcgccgaccctaacgtgagaccccggccggggccaaccggggttttcttgaggattcggcgcgattgttcggcacgcattctgataagagagctgcccaacggccgaaagaattgccggatcgtgccggggagttgcgcgactacccgttcgggggccagactgtgcgcgggcgatttattcttctcgggagtcgttatggcgcggcaggtaatcaccaccctgatcgacgatctggacggcaagaaggcggatcgcaccgtcgagttcagtctcgacggggtcagctacacgatcgacctttccgaagccaatgccggaaagctgcgcaaggctctggatccgtacatcaacgcgggaacgcggctcggccggacagccggtcgggtggcggcgcgcggggcggctccggcccgcaccgccggctcccgcgacgagaaccggttgatccgtgagtgggcgatcagcaacgggcacaaaatctccgagcgggggcgcattccgcaggaggtcagcaacgcgtatcgggcggcgcacggccgctgaccgcggcggggccccattccaccggctccggccgcgggccgggccgagccgcattccaccggctccggccgcgggccgggccgagccgcattccaccggctccggccggctcaccggccgcggccggtgagccgcatttccccgggcgcggacccgcattccgcgggacccgcgcctcggggtgccgtccgcattccgcgggaggccgccgccgccgtcgattggcatcgccgatgatgatcgggcggaaatgggcgtctgtccgacttggatggtttcaaatagtcgcgcgcagccgcggcagcccggcggccaccgcttccagggtcttctcctcgcccgcataccaactggactgcctgggccaatgcgtgatcacatcggtgaatcccagcgccgccgcccgcccggccgcgtcctggaacgcgtccacactgctcatcgagaacaccggtgacgagtcgagattgaggtaacggtcgaccgattccgggcgtcgcccggagccggccagggtgtcctcgaaacggttcttgatctcggtcaccgcacgccaccaatccgccgccgtctccgcctgcggaccggtggtgacccacccgtcgccgtaccgggcggcgagccgcagcgctcgcggcccgttcgcggccaccacgaacggcgggcgcggctgctgcaccgggccgggcgtgctgcgcgcgtcgaccgccgcgaagtactccccgcgccaggtggtgctcggcgagcgcaggatcgtgtcgaacagctccaggaattcagcgaaccggtccacccgggcccgcgggctcagctccgcgccgccgagtacggcggagtcgaaaccgatcccgccggcgccgagaccgagcagcagccggccgccggagatgtcgtccagcgcggtcgcctcccgggcgaagtgcaccggatgccggaagttcggcgacgcgacgtaggtgccgagccggatccgctcggtcaccgtggcagccgcggtcagcgtgggtaccgcgtcgaaccacgggccgtcgacgaggtcgcgccagccgagatggtcgtacgtccacgcgtggtcgaagccgaactcctcggcgagtcgccagcggcggctcgattcggaccagcgctggtcggggaggatgacgatgccgaaacgcatcggctcagcctaaggggccgctcggtcaggcggagcgcaggtcgtcgccggcggtgcgggagtcgtcggtggcggccgcctcgaaggcgcgcagtgcccgcaccaggtcctgccgggccgcgaccggcatcctctccagcacctcggcgagcaccgcccgccggcgctcccgcaaatcggccagcagccgtcgggcggccggggtgagcagcaaccgaacctctcgccggtcccgcgggtcgacgacccggcgcagcagcccggtcgcctccaggcggtcgcagaggcggctggccgaggacggcaccacgtcgagggcctcggcgaggcggctcatgttggtgtgccggttctccgcgacgatggtgagcacgcgcagctgggcgggcgggaccgccggggtccgggcgacccgggcgcgttcgagcacggccgccaacgactccaccgacgactcgatcgcggcggcgacatcgttggcgtgctccatggagttccccgtcgcgaagcccaacaaagactcaggtggatacccgccggtggcggcctgaaaccggtcagcggcgccaatccaggcacacggtcaccgcgtcgtcctccggctcggcgccggcgtgaaactcacgcaagccccgcatcaccgtaccgaccgcctcggccggaggctgcagcctagtcccccgcaacgcgctgagcagggcggattcgccgaaagtcggtccaccgccgggtgcggcggcgtgcactccgtcgctgatcacgaggagccggtcgccgggttcgatgcggaagcgttcgatctcgtagtgcgcctccccgaacatgccgagcggcagctgctgttccaggcggacctggctgatgtcgttgccccgaccgatcatgcagtgcggcgagccggcgtcgaccgcttccacccagccgctgaccaggtcgacctccagcagcacggtggcggcgtgcaggccgccaccgtaccgggcgtgcagcgcgtcagaggccagctcggcctgttcgatcaggtcggccccgcagcggcgggcgttgcgcatcgcgttcaccgcggtggccgtgaggatcgccgcctccaggccctggccggcgccgttgagcacggtgagggcgagccggtcgccggagagcgcccagtcgaagtggtcgccgcacacgtcgtaggccggttcgagctgcccggcgagccggaaccgctcgtcgtccagggagcggccgggcagcaggtcccactgcagttcggcggccatggtgagccgttccaggcactgcgcccggcggtagcggtcggtggcccggtcggcggcgcggatcgtcacggcgagttcgtcggcgaccgcctgcagctggtcggtctggtccggggtgggccggtcgggcagcacgacgcgcagcacgccgagccgctcgccccagcaggagatcggcaggtgtacccgggcccggccaccggggccggtgtccgtgttcacccgctggctggccagggtgcgcagggcggacgggtcgttgtcgggcgcggccgggctcagcagcggggcgaggcgacgctggggcaggtcggtgaccatcacctcgacctgctcggcggcgaagtgccggcgcaggtgctcggcggccacctcgggcaggcggtcgggggcggtggaacgcagcagggaaccgatgggtaccggttggtcggacacacgaactcctctcctgggctcaccggaccgatatttgttatacgacaaatatcgccgggcggggagtacgccgcgacgtggcgcgggtcaggcgaaggatttctcgaagtggatcagggagccggtgcgcgggctcgactgcatccgcacgttctcggcgagcgcgcggatcaggaacaggccacgtccgctctccccggccgtggtcggctcgggccggtcgtccgggtcgaacccggcgccgttgtcgacgacgtcgatcgaacagtgctgctcgccgacgtccaggcggacctcgaagtcctcggccccggtcgcgtgcttcaccacgttggcgcaagcctcggtcagcgcgatctccagatccgcgcccgcctgacggtcgatctgcagcgtggtcagtgaacaacgcagcaaccggcgcacggcgggcacactgtccacctcacggggaaggctgagccgaaccgacatgcgcatgccgtttctgtgcccgatcggtcatccggttaaccgtgtgctgggacaccgggtcgctgattcgtgttatccatactgcccgcgcccgtctccctggcagcacggaaggaagggcaggaacatggcgaaccaacccgacaccgccacggtggtggccgcgcgggccggcgacccggccgcgatcgaccggctcgtcgccggatacctcccactggtctacacgatcgtgggccgggcgctggaggggcacgcggacgtcgacgacgtggtgcaggagaccatgatccgggtcttgcgcagcctcggtgagctgcgcgagccggaggctttccggtcctggctggtggcgatcacggtgcgccaggtgcgggaccggttccgcaaccggcagagtgccccggacgcgctgctcgacccggacctgcgcgaccccggcgccgacttcaccgacctggcgatcacccggctggagctctccggccagcgccgggagaccgccgaggcgacccggtggatggacgaggacaaccgggagctgctctcgctgtggtggctggaggcctccggcgagctgacccgcgacgagatcgtcgacggcaccgggctgggccggcagcacgccgcggtccggatccagcggatgaagggccagctggagacggcgcgggcggtggtccgggcactgcaccggcagcccatctgcccggagctggcggtggtgatcgagccgtgggacggccggccgaacgcgctgtggcgcaagcggatcgcccggcacacccgggagtgccggatgtgcgccggcgcctggcaggacctggtcgcggccgagcggctgctggccggcatggccctgatcgcgccggcgccgcacttcgcgaagccgttgatcgccaccaagctcgccgccaaggtgggtctgggcgccgcgcagaaggcgctggtcaccgccctcgcggtcagcgtgatcggcgggggtggagcggcggtctacgcgttgagctcgcagaaggacccggcggcacccccggtcgcggccgtcgtgccggcaccggtggtcccggccgcggcggcgccgcgggtcagcccgtcggccacgccgcggcgtaccgccgcttccccctcggcgaaggccgccgtgccggccgccgcgatctcggcgaagaagggcgtcggcgtctggaagttcaccggctcggcggcggccctcaaggacgtccgggccggctggtactacgactgggccgcgcagaacgacgacgtccccggccccaccggtgtcgagttcgtgccgatgatctggggccggcagaacgtcaccggtgccacgctgcggcaggcgaagtccgagggccgggtgctgctcggcttcaacgagccggacatgggcgggcaggccaacatgagcgtcgaggacgccctggccgcctggccgcagctccaggcgaccgggatgcgcctggtcagcccggcggtggcgtacggcggggacaccgccggcggctggctcgaccggttcatggccggcgccgaggcgaagaagctgcgggtcgacgcgatcgccctgcactggtacggctcggacttcagcgccgcggcggtcagccagttcctcggttacgtcgacgcggtgcaccagcggtacggcaagccgatctggatcaccgagttcggcctgatgaacttctccggatcgccgaaataccccagcgacgcccagaaggtggccttcatcgagggcgccacggcggggttgcagaaacggtcgtacgtcgagcgttacgcctggttcgggctgccggccgtcggtgacagcgtcgacttcggcctctaccgggacgggcacagccccaccgaggcgggcaaggcctaccgcgccgcgggatagtgtgagtttcatgattcggttcgggtacaaggcgtcggcggagcagttcgctccggctgacctgctccggtacggcattctcgccgaggagctcggtttcgactcggtcttcgtcagcgatcacctgcaaccgtggcggcacgacggcgggcacgctccggccgcgctgccgtggctcggggcactcgccgcgcgcaccgaaagggtcctggtcggcaccagcgtgctgaccccgaccttccgctaccacccggccgtcgtcgcgcaggccttcgccaccctgggctgcctcgcgcccggccgcgccatcctcggcgtcggctccggcgagtcgctcaacgaggtggcgctcggcacgcagtggccggacggcaaggagcggttcgcccggctcaaggaagcggtcctgctgatccagaagctctgggccgaggaccgggtgacgtacgaggggcagttctacaagaccgagaacgtcaccatctacgacaagccgtcgacgccggtcccgatctacatcggcgcgtccggcccggccgcgacccggctggccggccggatcggggacgggttcatcacgaccagcggcaaggggcacgcgctctacaccgacacgctgctgccggccgtaacggagggcgcggagaagggcggcaagaagatcgacgacctggatctgatgatcgaggtcaaggtgtccttcgacgacgacatcgaccgcgcccgcaacgacacccactactggggtgcgctggcgctctccccggaggagaagaccggcgtcgaggacccggtcgagatgcagcggctcgccgacgcactgccggtcgagcggaccgccacccggtggatcgtctcctccgacccggccgagcacgccgccaaggtgaccgaatacctggacatgggcttcaagcacctggtgttccacgcgcccgggccggaccaggagcgcttcctgcgcctctacgcggccgagatcctgccgcggctgcgcgaccgctcctgaggctcagatcgccggtggtaccgaccgcaaggtgccggtacgcggtccggtgccgccgccctcgccgttgatcacgcgcaggcgggggcgggtggcctgctccttctccagggcccggagccggcgtgggccctgacggcggtccaccccggcgtacgcggccggacgcgaggtccgcggcagcaccgcgtcggtcccgatgcgggggagcacccgggtctgctccgggtccgccttcccggtcagcaccacgatgctctccgccggtgcgggtggggccacccggcgccgggtgtgccattcgccgagcagcgcgccgacggcctcgacgagcggcaccggccgggcggcggccgcggacggcacctcggtcaccgagagtccgttcagcccggcccgcacggtgagcagcgcgtcgatctccgccccgtcgccgcggaccgcgtcaaccccgctcactctgggtagttcgagcatcccggccgcgtctcgccagaacgcacggtaaccgaatccgggatcggtgcgccgggccccgaagagcgccgccatcatccacaacacgatccgcgccccgagcgtcggacgctgccgggcgccctgggccacgtccgatccgtcgcacagcgcctgcacgtagcggggcagttcggccgggtcgcaggagccgtcggcggcgagggtgaccacgatgtccccggtggccgcggcgaccccgcaggccagcgcgttgccggcgccggcgcgggtctgccggaccacccgggcgcccggcggcaccacggtgccggtgccgtcccggcgtccgaccaccacgacgatctcgtcgaccgggggcatcccggccagcaggacgggcagggcgaccgtgccggcccggatgacgacgctcacggtgggtgatgacggtcggtgtgacgcaaggggcatgggtggcaagctaccggctcgcaacccgccggcaactcggcgaaacgggggatgacgaccggccgtgcggctcggacggtccggtcaccgtgcgtacgaaagcggtagggtttgtcccgtgatgagactcgggctccatatctcgaacttcacctggccggagggcccgtcgcggctcgccccgaccctcgccgagatcgcctcggccgccgacgaggccggtttcgagcggatcagcgtgatggaccacgtctggcagatcggcgtcaacgggccgcccgagatggacatgctcgaggcgtacacgacgctcggcttcctggccgcgcacacccgccgggccaagctgctcaccctggtcaccggcgtggtctaccgcgagccgggcctgctcgccaaggcggtcaccacgctcgacgtgctctccggcggccgggccatgctcggcatcggcgccgcgtggaacgaggaggagtcgctcggcctgggcctgtcgttcccgccgacgcgggagcggttcgagcggctggaggaggcgctgcagatctgccggcagatgttcgccggcgacgaggccgcctacgagggcacgcactaccggctggcccggctgctcaaccacccgctgccgctggcccggcgggtgccgatcctgatcggcggcgccggggagaagaagacgctgctgctggtcgcgaagtacgccgacgcctgcaacctgttccccggcccggagctgcagcacaagctggacgtgctgaaacggcactgtgacacggtcggccgggactacgacgagatcgagaagacggtggtcttccgcttcgacccgggcgagcgcggggagaaggtcggcgagatcatcgacgcgatgcggcacttcgcggcgatgggcatcacggtgacccacggcgggctgcgcgacgcctgggacaccaagcgcttcgagctgttccgggacgagatcgtgcccgcggcggaggcgctgtgatcgaggcggtcgtcttcgacctggacggcgtgatcatcgacaccgaggaggtctgggaggaggtccgccggggctacgtggccgagcacggccgcgcgttcctgccggacagccaggaccggatgatggggatgagcaccgccgagtggtcggcgcacctggccgacgaggtcggggtgccgctgccggcgtcgcgggtggccgacgacgtgctgggccggatggccgagcgctaccgcgccgagctgccgctgattcccggcgcggtggagacggtccgcgcgctgggcgcccggttccggctggcgctggccagctcgtcggcccggatcctgatcgaccaggtgctggcgacggccgggttgaccggcgagttcgaggtcaccctgtcgaccgaggaggtgccgcgcggcaaaccggcgccggacgtctacctggccgcggtcgcccggctggggctgacccccgaggtgtgcgcggcggtcgaggactccagcaacgggctgcgggcggccggcgccgcaggcctcgcggtggtcgcggtcccgcacggcgtctatccggccgctcccgacgcgctcgcccaggccgccctggtggtgaccaaggtgaccgaggtgacgccggaggcggtcgcggcgttgcgctgagggcgacgagccccgcccccggcgtcgctcagatcgggtattccggtagctggaggtcggtgctgcggccggccgcgaccttgaacgtggcgtccaggaaccactgccggttgttcaggtagttgcgcaggcggatgccccgtgcggtgcgcggggccagaaagcggccggtggtgtcgccgcccttctgggtgccccgggcgaacttcgcgaggcgctgccggtagcgggggaaggcgacccggtggtcaccgccggccgcggccagctcgccggccaggacgtgggcggcgacgatcgcggtgccggtgccctgcccgccgatggtggcaccgcacgccgcgtcgccgagcagggcgatccgcccgcgggtccactccggcgcgtcgacccggcagatctggtcgaagtagacgtcgtcggccgcgtccagcgcgtccagcagccgcggggtcagccagcccaggccggcgaaggtggcgcgcaggatcgccttctgctcgcccgcgtcgtgccggtcgtaacgcagcaccggcgcggcgaacgcggcgaacaccccggcccggctcggatcccggtggtcctgaccgatgctgatcatccggccgggggagttgtgcaacagcgcggtgcggcccagatcgccccactcgttggcgaccggccaggtggcgacgtagtagccgagatgcttgacgaaacgctcctccgggccgaaggccagccggcgcactccggagtgcaccccgtcggcgccgatcaccaggtcgaaggtgcgctgagtgccggaggcgaaggtgacgtccaccccggccgggtgctcgacgagcgcggtgatccggtcgccgaacaggtatgcggtcgccttgctcgccgcgcacaggacccgggacagatcgccgcggcgcacctccaggtcgccgccggccaggtgggccggccactccatcagccgatcaccgtgctcgtcgacgaagcggaacgcggtgccgtgcgtctcgaccgcgcgcagcgcctcgaccacccccatccgctccagcaggcccatgtgcagcgggccgcggaagtcgaccgcctgcccgccggtgcgcggccgcggcgccacctcgacgatcgtcggccgatggccggcccgggccagccagtgcgccaccgcgggaccggcgatgcccgcacccgagatcaggacgtccatctcatgcctccagaaactgtttccgttggacaccattatttctgtgtacggtagacgcagttccgtgggagggcaacatggatttcctgtggcaggagcggaccggcggccgccgtgggccgaaaccggcgctgaccctgtcgtcgatcgccgacgccgcgatcgcgatcgccgacgccgagggcctggccgcggtcaccatgcagcgggtggccaccgacgtcggctacaccaagatggcgctgtatcggtacctgccgggaaagtccgagctggtcgcgctgatgctggagcgtgccatgggtgagccgcccgagctgccggccggtgactggcgcgccgccctcagccggtggtgtgagtcgctcatggcggtgttcgtcggtcacgcctgggctctgcaggcgctgaccggcaaccggccggtggggccgaacgagatcggctggatggaggccgccctggcctgtctccccaccgggctgaccggcgccgagcggatggacaccgtcgccgtcctggccggacacgcccgcgccctggccctacagccggccgagtccgggctggtcaccgccctgacccggcacgccgcccggttccccgcggtcggcgccgcactcgccgacatggccgtgcacggtggcgccgaccaggcattccgatttggactggagcgcatcctggacgggctggagaccttgatcacgaaacgcgtgtgaaacatcgtcgatccgggtaggcagcggccaacctgggaggtggccgtgagcggactccggctcgacgtgggcttcgtcgactatctgatccttgcgatctacttcatcaccgttctcggagtgggcttcatggcccggcgggcgatccgcgacagctccgatttcttcctctccggccggtccatgccggcgtgggtgaccggtctggccttcgtctcggccaacctgggcgccctggagatcatcgggatggccgccaacggcgcccagtacggcatgatgaccctgcactactactgggtcggcgcggtcccggcgatggtcttcctcggcatcgtgatgatgcccttctactacggctcgaaggtgcgcagcgtcccggagttcctgcggcggcgcttcaaccagccgacccacctgttcaacgcgatcagcttcgcggtggcgcaggtgctgatcgccggcgtcaacctgtacgcgctggccctgatcctgcaggcgttgctgggctggccgctctggctgtcgatcgtgatcggcgcggcgatcgtgctctcctacatcaccctgggcgggctctcctcggcgatctacaacgaggtgctgcaattcttcgtgatcctggccggcctcatcccgatcaccgtcatcggcctggtcaaggtcggcggctggcacggcctggtggagaaggtgcaggccagcaagatcggcgacgcggcgctgcacacgttcgcgaacaccgccgactccgacaacccgctcggtgcgaactggatcgggatcatcttcggtctcggattcgtcctctccttcggctactggaccaccaacttcgccgaggtgcagcgggcgctgagcgccaaggacatgagcgcggcccggcggaccccgatcatcggcgccttcccgaagctgctgatccccgcggtcaccgtgattcccgggctgatcgccctggtcaccgtccaggggctgggcgccaaggagggtgacctcacctacaacaacgcgatcccgctgctgatgcgcgacctgctgcccaacggtgtgctgggcgtcgcggtgaccggcctggtggcgtcgttcatggccggcatggcggccaacgtgagcggattcaacaccgtcttcacctacgacatctggcagtcgtacgtccgtaaggaccggcccgacggctactacctgcgggtcggccggatcgccacggtgatcggcgtgctgatcgggatcggcaccgcgttcatcgcggccggcttcgacaacatcatgaactacatccaggcgctgttctcgctgttcaacgcgccgctgttcgcgaccttcatcgtcggcatgttctggaagcggatgtcggcctgggccggtttctggtccctgctgctgggcttcctcgcctcgctcaccctctacctggggtacctgggtgacgtcttcagtttcaactccgacctggaggagagcttctggggagccggcgcggcgttcgtcaccgcggtggtggtggccgtgctggtcaccttcttcaccccgagcaagccggaggacgagctgcgcggcctggtctacggcctggccgggtcgagcacgtccggcgagacgatcgtggccggcgaccgagtctggtggcgcaacccggtggtgctcggcgccgtcgccgtggcgctggccatcgttctctacatcccgttctggtgaggtgaggtcatgaatcggctcttcgatctgcgcgcggtcatcggcggcatgttcaccctgtacggcgtgatcgtcaccctgatcggcatcttcgacagccccgccgacatcgccaaggcgcagggcgtccggatcaacctgtggatgggcctggccatgctggcgctcggcctgctgatgctgctctggctgcggctcaatccgcccaagccggtcgaggccggcgatgaccgggacacccctgaggtctgaggtgcgagggggtgtgcccgagttgccttctcgttgcacagcccccggatatcttcaagaccggtggcggtgcgtccgataacggtggcatggatcccctcgcctcaatcagcagcctcgcctccggcggccagcgctccgctggctggcaggcgcagcttcgggtcgactacgtcgtgaacaaggtgactcagacccatcgtggtcagtccgaggatcaggtcaaacaggctctgtctgaccagctccgagtcttcggcgtggtgcccaacgccaagcagatggccatctacgcgcgggccatcgccgccctgcccgaattaccgcccaacaacaagtgaatccagcggccaggaccgtccggcgaaggagccgggcggtcctgggtgttgcgtcgttgaagtaggtggccgcgccggccaatgccccaaacgatgcaaaatcgggcattctccggaatcgttgcacacccgcggcccacgatggtgcggcgcggccgagtcccgccgcgcagggcggagatacgggtttgcgtgcgttgcgacggccggtcacggccgcgatcctcaccctggccaccctgctcgggttcggccgtccggcgctcgccgcaccggcggtcacctggtcggtctgccccgaggacgcgcatgtcgaatgcggcaccatgcgggtgccggcggactggtcgaacgcgtacggaccgacgatcgagctgcagatggcgcggcggaaggcgaccgacccggcacaccggatcggggtgctgatcgtgaacccgggcggccccggcggctcggcggtcaacatggccctcgacaccgacttcttcagccccgagctgcgcaaacggttcgacatcatcggcctcgacccgcgcggggtgggccgcagctccccggtgctctgctcccaggcgctggtcgacgcgaaaccgtccccgctgatcaccgatccggccgggttcgccgcgctggccggctacaaccggcggctggccgccgactgcacgtcccgcagcggcccggtggtcgagcacgccgacaccggcagcgtggtccgcgacgtcgaagcgctgcgggtggctctcggcgagccgcggatcagcatcttcggggcgtcctacggatcgctgatcggtgagctctacagcgaccggtacccggccacgctgcgggcagcggtgctggacagcgtgatggaccacagcgtcgacgtggacaccttcctcgcccaggagaccgccgcggtgcaggactcgttcaacgagttcgtcaagtggtgcgcccgggacacccggtgcgtgctgcgcggccaggacatcccaaaactctgggccgccctcatgcagcgcgccgcggccggcacgctgaaggacccgtacgacccgccggccaagctcggggtctgggagctgatctcggcggcgttcgccgcgttctacgacccccagtggttctcgttcgcgcactacctgcaggacgcggcggtgccggcccgggcggtcgcgcggcgggcccgcaccgtggccccgccggccgacctcacgccggacagcttcccggcggtgttctgcggcgactgggcgctgccggtcggcgacttccccgcgtaccgccgccgcctggacaacctcgcgaagatcgcgccgcaggtgcgggcgtcgccgctggcgctctccgcggccgccggctgcgtcggctggccggtcgccccggccgccccgcagcaccggttgaacccggccaggatcccgatgctgctcgtcaacgcgctgcacgacccggccaccgggcacgcctgggcgcagcaggccgcggtccagctcggcccgtccgcccggctgctcacctatcagggctgggggcacgtcgcgtattcgcacagcccctgcgtccaggcggcggccgagaaatacctgctcacgctggcattgccggcggtcggggcgacgtgtcccgcggtcgagcccgagccgttcggcatcgggtaaccggtgcagcggttgtgcgccgtcggcgggcacggtaggcagatatcgacaagcgacactgtcctgtctggagggccgatgcggttcctttccgcgctagcagcgctttcactcaccagcctgtcgttgaccgcggtatcggcgcccgccctggccgccaccgggtcgacggcgcagggctacggcggcgcgatcgccaccgtcgacgccaccgccaccgccgccgggctggaggtgctgcgccgcggcggcaacgcggtcgacgccgcggtcgccgcggccgccaccctcggcgtgaccgagccgttcgcctccgggatcggcggcggcggcttcttcgtctactacgacgcccaccggcaccgggtcttcaccatcgacgggcgggagaagggccccgcgtcgatgacccccacctacttcgtgaacccggtgaccgggcagccgtacgccttcgacgaggcccgggtcagcggcctctcggtcggcgtgcccggcaccctggccacctgggaggcggccgcccgccagtgggggacccggccgctgtcccgggcgctcgacgacgccgccgaggtggccgaccgcggctacaccgtcgacggcgagttccgccgccaggtgaccgagaacgccgccgcgttcggacagttcgacgcgaccagggcgctctacctgccgggtggcgcgccgcccgcgatcgggacggtgatccgcaacccggatctggccgacacgtaccggctgatcgcccgtaagggcaccgcagtcttctaccgcggaccggtcggcgccgacatcctgcagaccgtcacccggcccccggtgtcgtccagcccctcctcgccctgggcctacccgatccgccccggcgtgctgaccgccgaggacctcgcttcgtaccaggtccgccgtccggcgccgacaagatccgactaccagggcttgtcggtgtacggcatgtccaccccgtcgagcggcggtaccgccgtgggcgaggcgctcaacatcctggacgcgtccccgctcgactccgcgtcgaccgtcgagaagctgcactactacctggaggcctcggcgctcgcgttcgccgaccggggccgctacgtcggcgcggacaccccgcgcccggtcctggacaccctgctctccgaccggtgggcgcggcagcgggcctgtcagatcgaccctcaccacgcactggtcaagccggtcgcggccgggccgtccgggtgcaccgcggcggccggcgcggacaccccggacaccgggatgagcaccaccaacctgaccgtggccgaccggtggggcaacgtcgtcgaatacacgctcaccctggaacagttcggcggcaacggcatggtcgtgcccggccgcggcttcatgctcaacaacgaactgaccgacttcaacttcaccggcacccagggcgacaatccggacccgaacctgcccggccccggcaagcgcccgcgcagctcgatgtcgccgaccatcgtgctcaaggacggccggccgtacctcgcggccggggcgccgggtgggtcgacgatcatcacgaccgtgctgcagatcctgtacgggcggctcgaactcgggctgaccctgccgcaggcggtcgccgcgccgcgggccgcgcagcgcaacaccgcgggtatccaggccgagcccgcgttccacaccacgtacgggccggagctgaccgcgctcggccatgtcttcgggccggacgcggcggagatcggcgccgccactgcgatcgaattcggtccgtgcgggtcgcagctcgcggtcgccgagccggtccgccggggcggtgggtcggccggggtcgtgcatccgcgttagcccgcgccgcagtggaacgtgccggcccccgccccggaggtccgtcagccgtgttccctcatccgcgtgccctcagccgcgattcgtcatccgcgattcgtcatccgcgttaaggagtaggccggttgcgacgatggtgcaggggcgtggagacgtccgggggaaggaagaagccatgatcaatgtggtggcggtcgcgatgctggccggaatcgttccggttccggcacttcccaccccgatggcctacgtccgcggcggggacgtctacgtcagcgccggaccggccgagaagcggatcaccaccggggccgggtacgcccgaccccggtggtcaccggacggcaggcagctggccgtgctcagggacggccggctgtggaccatgaagccggacgggaccgggcagcggcgggtcagcgaccggccggccggcggggcgtcctggtcaccggacgggaagtggctggcgttcgcgtccacctcctgcaccggggggccgggcgtctaccggatcgcggccgccgggtcgggcaacccggaagtccttttccccgccgggtgccgcggtgaggacctgcccgaggtcgaagcgccgcagaaggtgaccgggtcgctggccgaccggctgcgggtggacgacgcggtggcctggtcgccggacggcaaacagatcgccttccggggcggggagtgtgacgcggtctacgacgcctgcctgagcatcgggacggtcagctcgggggaggagcggacggtggccgcgtacggcggcggcagcctgcagaacaaggggttcgcggcggtgccggcctggagcccggacgggaaacggctcgcgttcaccgcctaccaggagggggagacggcggctgagaacgagccggtgcacgtcgtcgaatgggatccgggaaccggcgccaagaggacggtcggggtgccccaggaccgggaggcggcgtatctcgacgccgggcacgcactggtcacctcacagacccggggccactcctgggtgacgctggtcgacctgaagaccggcgcccgcaccctgctccaccagggctcccagccgtcggcccggcctcgctgaccgcgggcccggcggtatcgtggggcccgccatgactgagaccccccgcgacacgcccggccccggaatcgacgaacctcggccgatccggacttttcacccgaggcgggggcggatgagcagccggcacgcggacgcccacgccgcgctctggccgctgttcggcctgaccgtcctggacggcgaccgcaccccgctcgacctgccgcggctcttcggccgtgcggcgcccgtcgtcctcgagatcggattcggcatgggcgacgccaccgccgcgatggccgccgccgacccggcccgcgactacctggccgtcgaggtgcacaccccgggcatcggcaacctgctggccctggtcggcgacctcgggctgaccaacgtccgggtcgccctcggcgacgccatgcagctggtccaccggatcgccccggaggcgctcgacgccgtccacgtcttcttcccggacccgtggcccaaggcccgtcaccacaagcggcggctgatccaaccggcgaacgtggccctgctccgcgaccgcctgcaccccggcggtgtcctgcactgcgccaccgactggccgcactacgccgaagccatggccgaaaccctcgacgccgaccccggcctgcgccgcctccccgccggctcgccgcacacccgcccgcgcaccaaattcgaaagacgcggcaccgaggccggccggcccatcaccgacctgcgctacaccagaatctgaaccccgctcagccggtacggggtgccccacccgtccgcgccctgcctcgtccggccctgcccatccgcgctctgcctcgtccggccctgcccatccgcgccctgcctcgtccggccctgcccgtccacgcctgcctcatccgggccgaatcgggccgccgcaccctggcgatgcggcggcctgctccgtcacttcttcttcttgcccttcttgcccttcttgggcgcctccgcggcctcgtcctcgaccgcggcctctgcagccggagcctcttccgcggcggcttcctcgaccggagccgtttcgtcggcggcctcggtctcctcggtggtctcctccgcggggcctacctcggtcgcggcttcctcgccgggagcttcctcgcccggagcttcctcggcagccgtctccgccacggcgacttcctcgtcggccggcgcctcgacctcgtcggccggcgccgcgtcgacggtggcctccgcagtcttcttggccttcttgcccttcttcttgcccttcttgggcttctcctcggcggtggcctcgacggcggtctcttccgcggtggcctcttccgcggccggtgcttccgaggcgggctcctcggctgccgcttcctcggtggcgtcgtcggccggagcgtccgcggtgtcctcggcctcggtggcgtccgcggtgtcggcggcggcctcggctggcgcttcctcggtggcgggctcgtcggcgccgtcggcttcgtcggccacgctgtcctcagcggcggcctcgtcggtgatgggctcggccgacttcttggccttcttgcccttcttcttcttgtccttcttgggctcggcctcggtcggagcgtcttcggcctgagcggtctcggtcgaagcggtgtcggtcggagcgtcttcggcctgagcggtctcggtcgaagcggcgtcggtcggagcgtcttcggcctcagcggtcgcggccggagcggcctcgaccgaagtggattcggtggtctcctcggccgcgacggtctcctcgaccggcgcaaggtcctcgagcagagcagcagccttcttcttgcccacgggaattccctttcccttcctcgcgcacgacccggcggcgcgcgtgccggaactgtagagacgtcgaaccgatagacggaattcacgttatcgaaacgatacgttcatcgtttcctattcgggtggcggtgacggcgcgcaacagtcgtcatgaattcgacatccgggcattccggtgacgttgagctcatttgagcaggacgaggcggccccgtcctgttgttacgccacccgatcggctggccagcgatgactctgttccgttcggtgtcgatcgcgtggtgtcacggattgccggcgctcaacgatcaagacactggtgcgtggagagcccaggagggcagccagtcctcgatccggtcctttacgtcgaatttccgagaatgacggcgattctcggtcggagaccgatgaaaggcacaaaagtcggctgagaaaatgctgtgaacggacgttgggggcctggccccgcacgggccaggcggcggtactgaggcgccactccggggcgcgagcgcgcagggcggggtgctcacgacgtaccggcaaatcggcggtgaagaccaccgcctgcccggcgccgaggccgcggtcccggggcggcgaccatcgagaggcttcgtcttgcgggcggtgccttgtggtgctggagcgcggatccggcggcggggtcgggccgggaagcggctcgcctggccgcgcgatttgacggttttagggttttcgtgcatctaggctgggttgtggaggtcggccatgcggcgagaagaccccggcagtggcgccgggctgcccggaagggcgtcggcggcggaagccgcggcactcgcgcgtgcggccgagcttcacggggggacggccgtcgacgagcatcccggcttgccggcggccgccagcaaagctttcggcaaccgtgaggcgcgcgtgggcggtgacttccggcggatggccggcaccggcccggtcgcgggcagtgagcagaccgacggcgggttcggaccggcggacgggtcggtgcggcggcgggtcggcggtgaggtggccggcggggcgcacctgctgcgcgatgtgctcggcggggccatgctgccggtgctccaccgcggtgtgctgaccagcggcaccgccgatcagctggccgcgctgaccgcccgcggggcgcagacgccgagcgcgtgcatccagttcgtcgagggggagaagctccgactgtacggcagctggggtgtcgccgaggactgggcggcgatcgccgacaccccgctgcacggctcgctcggcgggctcgtcgtgcacgggggcggcgcggtgatcgtcgacgacgcgaccgtcgacgaccgggtgccggacggggtggtgcgccggcacggcggcgcgtacctgggacatccggtgcacgatcgggacggacaggtactcggcgtgtgctgtgcctacgacctgcggccgcgcgagtggtcgccggagcagatcaccgcggtggccgaggcggccgaggtcgccaccctgctgatcggcgagcagctggcgcggtacgagctggagcagcagcaccggttcctggacgcggtgctggagagcctgcacgacggcgtgatcgcctgcgacgccgacggacatgtcgtgttcgcgaacgagcggatgcgccgcacctgggccgacgacccgcgggacaccgacgagctcggcctgttccgggcactcgccggggaaccggtgcgcgacgagccgctggcccggcccagccggaccaaacggacccggcactttctgatcgacgcccagccgatcctcggaccggacggtcgggtggtcggcgcggtccaggcgatgcaggatgtgacccggcagcgccgggcggaacgcttccgctcctgcgagctcgcggtgaccacggcgctggccgaggcggcgagcatcgaggcggccgggccgcgggtgctggaggcggtggtcgccaccctcgactgggtgcacgccgagctgtggatggccgacgcgggtgcggcggtgatccgggcggcggcccggttcagcacgccgggctgggcgaccgggatcgccgtgccggacgagctgacctacggtcaggggctggccggacaggcctggcaggtcgacaaaccgctgtggatccgcgacgtgggccactcggacagcgtgatctccccggacagcgcccaacggctgcacgccgcgctggccattccggtgcacgacgggaccgggacgatcggggtgctgaccgtcttcaccgacgcggtcgaggacccggaggacgagctggtcgcgctgatgtccgggatcgccgcgcacctcgggcagttcgtcgaacgccgccgggtcgaggacctgcaacggcaactggtgcgcagcaagaacgaatacctggcgctgatcgggcacgagctgcgcaccccgctcacctcgatcagcgcgtacaccgagctgctgcgcgaggcggacgaggccaccctggtccgcgacgggccgcgcctgatcgccgtggtggaacgcaacgcgctgcaactccgggagatcatcaacgagttgctcgaactgtccgccctggacgccgggcacgccgacgtccggcgcaccccgatggacctggccgaggtggtccgtgacgtggtggaccgcacccgggtggcgatcggcgccgcccccgtggcgatcgacaccgacctgccggccgagctgatcgtgcccggcgaccgggaccggctgcggcacatcgtggagaacctgatcggcagcgcgatccggtacagcccggacggcgggcacgtcgaggtccgcctgcgccgggccgggcgggccgccgaactggccgtctcggacgcggcggtggacgtgccgcaggacgagcgggaaaagctgttcactggtcgctatcggaccagccgcggacatgagcggacgctgccgggcagcgggctgggactcacgctgagccgggcggtggtggaacgccaccacggcagcatcgagctgaccggcgacggggacggcacgaccgttctggtgcggctgccgctggacgcccggtgatcccgctgccgttgacaagtcattgacacatgtaaccctggcccgcggaccagggcggggcgaggatgagcggcatgacgcgatggactccggatccgacgttctacccctcacccggcgacgcggccggcgcccccgcggagaagctggcgtacatcgccgccttcgaccgttccgccacccgcccggacgcgctcgcggtggtcgacaccgaccccggctccggcagctacggcagggtggtcggctggaccgacctgccgcacaccggtgacgagctgcaccacttcggctggaacgcctgctccagcgcgctctgcccgaccgccccgcacccgcacgtcgagcgccgctacctgatcgtccccggtctgcggtcgtcgcggatctacgtctacgacacccagcccgacccgcagaacccgcggctggtcaaggagatcagcgccgcggagctggcggccaaggcggactactcgcggccgcacacgatccactgcgggccggacggcatctacgtctccgcgctcggcgccggccagggcggcgggccgggcggcatcgcggtcctcgaccaccagagcttcgacgttcgcgggcagtgggaggccgaccgcggcgatcagaaactggcgtacgacttctggtggcacctcacccaggacgtgctggtcacctccgagtggggcacccccgacatgatcgaggacgggctggtgccggagttgctgctcggccggcagtacgggcaccggatccacttctgggacctggccaagcgcaccctggtgcagaccgtcgacctcggcgaccagtaccagatgacgctggagctgcgcccggcacatgacccggccgcgacgtacggcttcgtcggggtggtcgtctcggtcgaggacctttccgcgtcgatctggctgtggcaccgctccggcgggcagttcgaggtccgcaaggtgatcgacatcccggccgagccggccgacccggccgacctgccgcccgccctgcaaccgttctcggcggtgcctccgctggtcaccgacatcgacctgtcggtcgacgacaagtttttgtacgtgtcctgctggggcaccggtgagctgcggcgctacgacgtcagcgacccgttccaccccgtcttcgtcgactcggtgcacctcggcgggatcgtgcggcgcaccccgcacccggcgttcccggacgagccgctggccggcgggccgcagatggtcgaggtgtcccgggacggcaagcgcgtctacgtcaccaattcgctgtacggctcgtgggacgaccagttctacccggacggggtcggtgcctggctggccaaactggacgtgaccgacacgtcgttcacgctggacgaccggttcttcccgcacggcgacgaattccgcggcctgcgggtgcaccagacccggttgcagggcggcgacgcgtcctccgactcgtactgcttcccgtccgcaccgtgacctgggaaacctatgccgcgctgatcgcgctcggggccttccatgggctgaacccggcgatgggctggctgttcgcggtggcccggggcatgcaggaacgcagccgccgggtgatgctgctgtccctgcccccgatcgcggccgggcacctcgcctcggtcgcgatcgtcgcggcgatcatctcggccacccggtcggtggtcgccgcgaacgtggtcggcatcgccggcggcgcgctgctggtcggcttcggcctgtggcggctgctgtccgaacgccacttccgctgggccgggatgcggctgtcctcggcccagctggccggctggtccttcctgatgtcgtcggcgcacggggccggcctgatgctgctcccggtcctcaccaccaccccggtgccgggcgcgtcccacgccggccacgcgatgccgggcgccggcgccggcggctccccgctggccgccctgaccggcctggcggcggccggggtgcacaccgtcgcgatgttcaccgtgatggccggctgcgccctgctcgtctacgaattcctgggcgtgaacatcctgcgccgggcctggttcaacgtggaccggttgtgggcgggggtgctggtcgcggccggcgcgctgaccatcgccatcaccgcctgatgccgccgcccggcgatcaccatgactggcggaagccgccgcccggcgatcgccatgaccacctgacggcgctgcccgaagatcgccatgacggcctgacgccgccgcccgaagattgccatgaccgcctgacgccgccgcccggcgatcgccaccaccgccccgccgtgaccgtgccgatcccggcgccggcctctgtctgaagccggcgccgggcatgttgccgtctcagtccgtgacggggaccggccggcgcgatgccgcgggtgtggtgcggcggccggcgcccaggtacaggccggtcaccgcgccgagcatgagcaggccgccgacgatggtgggcagcgccagcggctcaccgatcaggacgaccgccagcccggcggcggtcaacggttcgagcagggtgacgaccacggcgacactgccggtggtgtgccgcaacccggtgtagaagcacgcgtacgccagagccgtggtgatcgcccccaggtaggcgagcagcacgatcggcgtgacacccggcgtgaacgtcagcccctgcacgatcgcgaccggcgctagggcgaccgccccgatcgcgcacgacagcgtggtcagcaccagtggtggaaccccctgcgtggtgtgccggctgagtgccgtcgacgcggcgtacaccgtgccggacgcgatcgccgcgagcaggcccagcccggtgctcgacccggtcgatccggtcgtgcccgaaatcagcagcaacccgatgaccgccgccaccgaagcgccggcctgcgcgttttcgggccgccgccgggtgcggatcgtctcccacacgctgagcagcaccggagcgagcccgaggctgaccacggtcgcgatgctcaccccgctgaggcgcaccgcgagaaaatagagcgcctggtacgcggcgagccccaccccggccagcacgaccgtccccggcgcggaccggagagccaccccgatctgccgccgcgcccgccccccgaccaggagcatggtggcggccgcgaacagcagccgatagaacccgatggccaccgcgccgagtccggtccgcccggccacgacttgaacgacgacgccggcggtgccccagaggaggccgccgatggacagttgcagaaggctgagccgagggttcaccgcggcctcagacgacgagaagaacgaagacatgcgcgcactccgcagaggtgagtcggttccgggaccggcagcggaacgcagcgctacaacgccgccgagccgagctcaggcagcgacgacaccggctccgctcaggagcgcggcggcgagagacgcccggagaacccgttcacacccccacggtaacccacccgggccgcctgccccgcgtgcaccgcagcccgtcccgccggcctgcccggcacggggcgtcgccgggcctgagccgttgcccgggcctgaagcggcgccaggcctgagccgtcgtccgggcccgaagcgtcggcgacgcttgaagcgtcgcccacgcctgaagcggccgttccccggcgcgggcagcgcgccggggaacgggctcgggggagggccggccggtgactggccgaccgagccaccacggcgggtccgccgtcggtggcgttccgcccggtggccttgcgccggcggggaagcgtcggtgctgggcgaggccgggctggcggggaagcgtcggtgccggctcggcttccggtggtcggtaccggggccgggccggcggcggtggtggtggctgtcaggcggcgggggtggaccagatggcggtgaaggcggcggcctcgccggccagccagctttcgacgtcggcgtggcgggtggcggggttgaggcggtgggtgacgccgcggcggaggtcgaccaggaccgggtcggcgtccgggaggatctggtccatgtgccgggccatcaggtggagcatggcggtgaccagttccggggtgggcggctcctcgtcgaagtggatgcggaccgcctcgcggtggccgtcgtcgaagcgcaggccgaagtgcgggttgatcttcacagcgagggggccgacgctggccagggcatcgcgggtctggatcagcgtgaccgcctcggggtcgccgagcgaggccaggtaggtgcgggcgcccgagcgcagcgactcgtagagcggcttccaccggtctttcaccaggtcgacgacgccggcgagatagctgccgccggtgcggaaggcgatgtccgtcttcagcgctttgatcagctggctgtgcgggttgaaaccgcggcgccgctcccgctgcttgcgcagcccgccgacgaacgtggccttggcgggaccggtgcgcgagacataccgcgtgaagcccagcatcgttgcgtacggcgggatgacgggcacggggttggtcgagatcgtggacagggtggacgtggtcacgtcggtctcctcactcgcgctgcaagccatcgaacaggcgttcgaaaccgtccgaagatcagcagctcagggcccctctttcgtacacacattctaatcgacgggtacgacattcccaaccgcacgggcggcccgccgggcgtcgaggaggatcgatctcggacaggccgggccgtgccgtgccgcggccgcggggccgcggcggaaaggggcggccgcggcggaaaaaggcggccgcggcggaaggggcggccgcgggttccacgaagcgggacgagtgccgcgcccgtgccggtgcgatggccgagaatgggacgtgtggccctgatccgctgtgacttcgactccgaggcgctggaactgcgtacctcgatgacggtgatcctgcccgacgaagacgccggcaccccgccgccggtgctctatctgctgcacgggttgaccgacgacagcaccgcgtggagccggttcacctcggtcgagcggtatgcggccgagtacgggctcgccgtgatcatgcccgaggtgcaccggagcttctacgccaacgaggcgtacgggatgcggttctgggacttcctgtcggccgagctgccggagacggtgcgcaagttcttccgggtgtcggggcggcgcgaggacacgttcgtcgccgggctgtcgatgggcgggtacggcgcgatgaagtgggcgctgcgcgagccggagcggttcgcggcggcggccacgctctccggggctctggacctggcgtacatccaagaacatgatcttcgaccgcacatgcgcgccctggtcgcacgggtgttcgcggaccgggtggtggccggcggtgacgaggatctgctgcatctgctgcgcaccggggatccgggccggctgccccggctgatgctgcgctgcggcaccgaggatcatctgctcgcgcagaaccgccgcttcgtcgccgcgtgcaaggcgcacggggtggagctcgatgtgaccttcagcccgggcgggcacgcctgggactactgggacgcccagctcccggccgtgctcaggtggatgctggaccacaagtaggcgacgggccgccggtaaccgcgggcggcccgtcgaagcgggaggtcagttctcgtcccgggcctgctcggcgaggaagcgttccaactccgccccgagctcctccgcggtcggcagcggcgtgtccgagtcgaccagcaggttgttggcccgcccgcgcaaaaaggcgtcgtactgcgcctccagggaggcgaccagccgggcggcctgctcgtcgtcggcgatctgcttgtcgacctcttcgcggacgagtttcgccgattcgcgcaggccgccggtgggcagcgccagcccggtgttctgcgagaccgagtcgagcagcagttcggcggcggccgggtaggcggtctgggccaggtagtgcgggacgtgcgcggcgtagcccagcgcggcatgcccgttctgcccgagccggaattcgagcaggttgccgacgctggccggcacctggacccgctgcagccacgactcgtgttcgccgagcagactcttgtcggtggcgtgcgcggtcatgctgaccgggcgggtgtgggggacggccatcgggatcgcgttcagcccgatggtggccttgaccccgaggcggtcgatcaggccggtgagggcggcgatgaagcgctcccactgcaggtccggctcggggccggtgagcagcaggaacgggatgccgagctggtcgcggacgaggtgcagggcgagcaccgggtcgtcgtagctctcgaagtggtcggccacgaagatcatcgggggccggcgggaccggtagtcgagcagctggtccaggtcgaaggtggcgacgacctcgctctccaaattttccagaaggctttcccgggcgagctggatcgcgctgcccgcgtcgacgaacccggtcagcgcctggatgagcaccgggccgtccagggccggcaactccccggccacctcgtagagcccgtgtgggtcgagcacgctgcggacctcctcgaagacgtcgcccgctctcgcgggctttccgctgccaacagccgggccgcagagttcattccggcctcttcgcatcattacgtacgacggggcccgccggatgggtgggcggcgccctgccgggtatccgaccgtgccgacgctgtgacgatggccaccaaacgtctcgcgaccggcctgccatcgcgatcggcggctaagcccccggcggatccgcccgaacctgaaggcgtgccgaggatccggaaagccgtcgccgtcgccctgcccctgctcgccggctcgctgctgctggccgcctgcgcctccgccacgaccccgcaggccgccccgtcgcccaccgggacgccgtggctgctgatggccaccggcagtgtcgccccgtcgccgacccgcagcgtctcgcccggcaccaccccgggcctcgccagcctgccgccgctgccctccgggtcggcgaccccgcggcccagcggcagccccggctgtgacccggcggtcttcaagggcggccagatcaacggcctcgacgtcaccgcgggcagcaccaccgccaccgtgaaatggttcaacccgggcggagaccagctggtcgactaccacattctggcggtcagccagaagctggtggtcggtgcgcagccggagacgccgggctggctcaccgtgacgccgaccgcctgtggctggatgaccgccacggtcaccgggctgatcccgaagacgccgtacgtcttctcggtggacggcatgtggctgcgggcgggcacggacggcacctacacccgcacggtggcgcgctcgggtgtgatcaccacggcctgacataagctttccggccatggagagcatcgtcgacacggtcgtgctcgtggcgatctcggtggtcggcgcggcgctcgcccggcgactcggtttcgtggcgccgctggtcctgctggtggcgggtctggcgctgtcgtacgtgccgggtttcccgcaggcgcacctggagccggagttcgtcctgatcggcatcctgccgccgctgttgtacgtggcggccctgcagacctcggtgcccgccttccgcagcgcgttacgcccgatcctgctgctcgcggtcgggttggtgctgctcagcgccttcgtgatcggtttcgcggtgcactggctgctgcccggcgcgccgctggccgcctgtgtcgcgctgggcgcgatcgtcgccccgccggacgcggtgtcggcgaccgcgatcgcccgccgggtcggcctgccccggcacgtggtcaccatcctcgagggcgagagcctgctcaacgacgcgaccgcgctggtgatggtgcgcatctcggtgagcgcgctgtccgggaccgcggtcggtttcggggagatcggccggcaggtcgcgcagaaggccggcggcggcatcgtgatcggcatcgtcgccgcggtggccgccgcgaagctgcaccgctggatcgaggatccgctgctcgacgacgccgtgtcgttgctcaccccgttcgtcgtggtgatcgtcgccgaggagttgggcacctccagcgtggtggccgtggtgatcaccggcctgtatctggggcaccggatcccgtacctgttgtcggccacctcccggctgcagacggacgcggtctggcggctcgtcaccttcctcctcgaaggcgtcgtcttcctgctggtggggttgcaactgcggatggtggtggacgggatcgagaccggcgtggccaccacggtcagcgtcacggcgctggtcttcgggctgctggtggcggtccgcttcgtgtggatgtatccggcgacgtatctggggcggctcttcccccgggtgcgggcgcgcggcccccgggtgccggtcagcgtgccgaccgtggtggcctgggccggcatgcgcggcgtggtgacgctggccgccgcgcagacgctgcccctgccggggctcagggacgtcccgatgtatccccgggacctgttcatcttcgtggctttcgcgacgatcgtgctgaccctgctgctgcaggggaccacgctgccgggactggcgatccggctgggcgtgcgcgaggacaacagcgcccaggacgcgctggccgaggccggcatccagcacgcggcgagccgggccgccctggccgcgctggaggagaacgcggacggcgcgcccgcctcggtcgtcgaccggctgcgcgggctggtcgagagccgctccaacaacgcctgggagcggctcggcagccagcagcaggaaaccccctcggccgcgtacgggcggctgcgacgcgagatgatcagagccgaacggcacgtcttcaagatcgcccggaacgagggcaggatccccgaggaggtgctggtccgcgcccagcgcgagctcgacctggaagagtcccagctgcgacggagtgaagagtgatctgccagcatctcaaggagtccggcgagccggccccgctcagcgcgtacgaggacggctgcccgcagtgcgtcgccggtgggttcgacgactgggtgcacctgcgtctgtgcctgtcgtgcggcctggtcgcctgctgcgactcgtccccgcgccgccacatgtcggcccaccacgccgagaccggccacccggtgatgcgctcgttcgagccgggggagacctggcgctggtgtttcgacgacgagcagctcggatgaggatcctcgtcgccggggccggggccaccggcggcttcttcggcggccggctggccgaggccggacgggatgtcaccttcctggtccgggagggccgggcgacggtgctcgccgagcgcgggctgcggatcaggagcccgggcggtgagacgcggctgacgccccgggtgatcacccgcgtcgaccggcactacgacctggtcgtcgtggcggtgaagagctatgccctggacgcggtggtggccggcctgggcgccgcgatcggcccgcgcacggtggtggtgccgctgctcaacgggatgcgccacgtcccgacgctgatcacggcgttcggcgtggagcacgtctggggcgggctctgcatgatccacgcgacgaccgacgagcacggcgacgtggtgcagatgaccgggctggcccggttggtgtgcggcccgctcgacggcggcccggacgaccggatggacgcggtggccgcggcgatcggcgaggccggtttcgacgcgcggacctcccggcacatccgcgccgagatgtgggagaagtgggtcctgctggccacgttgggtgcggcgaccacgctgatgcggggctcgatcggcgcgatcaacgcggcgccgggcggcccggaggtcaaccgggcgatcgcggacgaggcgatcgcggtggccaccgcggccggtttcccgccccgcccgcaggcccgggagatcgtccacaccacgatcggcagcagcgagccgaccacctcgtcgctgtatcgcgatctggtcgccggccggccggtggagggcgacgcgatcgtcggtgacctggtcgccgagggccgccggcacggcgtccggacgccgctgctggccgccgcccacaccggcctcgccgtccattccgcctccgtaagctgacctcacaccctcatggcggagtggatctcgccggacatcgcccgcgccgccaggatcttcgaggagatccgcggcgcggcggccaccggatagacctgcgcggtgcgcgccgcgatggacggccagttgaagtcctcgaccacccgcgcccgggcccgcgacgccagcccccgcgcgtactcctggtcgctgagcaccccgctcaccgccgccgccaggccgcccgggtcacccgccgggaagtgcaccccggtcaccccgtgctcgacgatctcggacagtccgccggtcgccgccaccgccaccggtgtcccggccgccgccgcctccaccgccaccatcccgaacggctcatagatgctgggcacgacgtagcagtccgacgccgccatcagcgcggtcagatcatggccggtcaggaatccggcgaaactcacggtctcccccagctcgcggccggcgagttccagttcccgccggtacgggccgtcgcccgcgatgaccacccgcagtcccggaaagcgttcccgcagttccggtaccgccgcgagcaggtgctggacgcccttctcgtagaccagccgcccggcgaagctgatcagcggcccgcccgtcccggcatattcgtcccgggccgccgcgaccgcccgcggccgcgcccgccagcgcagcgcgtccaccccgttgggcaccacgtcgacccggccggccggcacttcgaagtgccgggtcacctcggcccgcatgtactccgagcagacgatcacccggttggcctcgtggcacagccagcgttcgatgtcgtcgatgctccggttgtgcgcggccggcagccatccctggtgccggccggactcggtggcgtgcacggtcgccaccagcggcacgtccaggtggtcgcgcagggtgacggcggcgtgggcgaccagccagtcgtgggcgtgcaccacgtcgaagcggcggccgcgcgcggcacgcagcgcggcccgggtgagcgtgtggttgaaggcgagcgcccaggccagcaggtcaccgccggccacctcgaaggcgggcgggtcctccggggcgcggatcacgcgtaccccgtcgccgtgctcctcgacgagggccccgggcgcgtgccgggtcacgacggtgacctcgtggccggccgcggcgagtgccccggccagcgcgtgcacgtgccgcccgaggccgcccaccagcagcggtggatactcccaggagagcatcaggatccgcctcatggggcgtacctcgtctccactcgtagcatctcggcgacggccagcgcgtcgaacggccgcccgaccgccgggtgcggcgcgtccccgtgcgcggcctcgccgaccgacccgaggccggcttcggcgagctgcgcggccaggccgtcgagcaacccgtcgaccggccggccggtggccgcgcaggcgtcggcgtacggcccgatcagccacggccgcacccggccctggtccggttgcgagccgtcgtagccgtattcgtccggggcgagcgtgcgcagcccggacggggtgagcagggcccgtcccacggcccggaccggcccgtcgccaccgccgcgcatcggcccgtgcggcagcgaccaggcgagcagctggtacggccgcagcgtcggatcgtcatgctgcgtcccggcgcccagcgggtacggcgcggccgggccttccacgatgtcgtggagccagccctcgggggccgggaagcgtcgcaggaacgaggcgcgggcgaccgcgtgccggccgcgcggctcggcgtcgtcgcgcccgccctcggcgagcaggtcggccaggccggccagggcgttcacccagagcgcgttgagctccacgagtttgccggcccggccgccgtcggcgggcagggtgagcaggccgtcgtgcggatccagccgcatgccgggcgaggcggccagcgactggcgcagcagccggccgagcgggacggccgacgcgcgggccaggtcgctgtccccggtgcgggtcacgtgccggtcgatcgcgtgcaccagccagagcgggaagtcgacctcgccggacggctgctcgaccagggcggtgagcagctcgcggccctcgtcggcgcggccggtgtcgaggaacaggccctcgtaggcggcgagcggggccggccggcccgaccacgggtagccgtcggccacctgcgggccgtcgaggatgaaggtgtcggccgccagggccagggttcccgcgtacccctccgccttggccgcggtgaccagccgatgggcccgttcccgcgccgcggccaggaccaccggcggcgccggcgggcgtaccgccggatcgccggcccaggccgagatctccaggctctcgcccggtccgacctgcttgccgaaggtcccggccagccacaggtcctcgatctgctcgccggtgcgggcgcccagatgccactgcccggcagcctgccaaccggttccggccagccggtacgcgtcctcgatgaccaccccgtcggcggccggctcgatccgcagcccgggtccgtcggcccgccggctggtggccgcggcgcgccaggtgcacatcgcggcgacggtcagggtgaccgggccgggcgcgctgagcacgcgatggatcacggcgaggccgggccgcatcgcgagttcgcgctcgatcaccacgtcgccgatccgccagcgccagcggggcagtccgccggcgagggtgaacgtctccaggaggcggtagccggccggatcgaggcgcccggattcccacgcatgggtgtaaagcgggactttggtgcccgtggcgagcgtcacggtcagatcgagtgaggccaacgccacgtgtggcgtgcgtcccggtccgccgacgcacagcagggcgtgttcgggtcgggtgcgcaggccgctcacggtgcccgaggcccacccgccgagaccgtcgctgaccagccattcccgtcccgttccggcgtccggtgcggggacgccgcacacctgcggaccgaaggtcaggagatccatgcgcggcacgtcgtctctatgctcgttttcgaacacgctaaacccccgtaaggggataaattagcgcctaatcggacagtcgggccgaccgtatcagcccgctccggaagaattgccgaagacgcggccgggcaggattaaccgaccccgcggatgggcatgaaccgcgggccggtcgcgaccgacgcaaggccgaggggggttcgacacatgcaggtctggcctggtcaccggtatccactgggggcgacctacgacgggaccggtaccaacttcgcgatcttctccgaggtggccgaggcggtcgagctctgtctcttcgacgcctccgggaacgagcgcaaggtgctgctgcacgagcaggacgccttcgtctggcacgcgtatctgcccggtgtcgagcccggccagcggtacggataccgggtctacgggccctacgagccgcaccgcgggctgcgctgcaacccgcacaagctgctgctcgacccgtacgcgcgggcggtcgactcggacatcgactggcatccctcgctgtacgcgtacgagatgggcaaccccgaccagatgtcggacctcgactcggcgccgtacatgcccaagggcgtggtggtgaacccgtacttcgactggggcaacgaccgccggccggacatcccctaccaccactcggtgatctacgagacccacgtgaaggggctcacccagcggcacccggagattccccgggagatgcgcgggacgtacgcggcgatcggccatccggcgatcatcgagcacctcaagagcctcggcgtgaccgcggtcgagttgatgccggtgcaccagttcgtgcacgacaaccggctgcacgacctgggcctgcgcaactactggggttacaacacgctgggcttcttcgcgccgtaccacggttattccgggaccggcacgctcggccagcagacccaggagttccgcggcatggtcaaggccctgcacgcggccgggatggaggtcatcctggacgtggtctacaaccacaccgcggagggcaaccacctcgggcccaccctctcgctgaagggcatcgacaaccgcacctattaccggctggtcgacgaccagccgcagttctacatggactacaccggcaccgggaacagcctgaacgtgcgcagcccgcagagcctgcagctgatcatggactcgctgcgctactgggttaccgagatgcacgtcgacggcttccgcttcgatctcgcgtcgacgctggcccgcgagttctacgacgtggaccggctctccaccttcttcgaggtggtccagcaggacccgatcgtcgggcaggtcaagctgatcgccgagccgtgggacgtcggcccgggcggctaccaggtcggcaacttcccgccgaactggaccgagtggaacggcaagtaccgggacacggtccgcgacttctggcgcggcgagccggccaccctggccgagttcgccagccggatcaccggctcggccgacctctaccaggacgacgggcgcaagccgttccactcgatcaacttcgtcaccgcgcacgacgggttcaccctcaacgacctggtcgcgtacaacgacaagcacaacgaggccaacggcgaggagaaccgggacggcgagagccacaaccggtcctggaactgcggcatcgagggccccacccaggacgagaaggtgctggagctgcgcgccaagcagcgccgcaacttcctggcgacgctgatgctcagccagggcgtgccgatgatctcgcacggcgacgagctcggccgcacccagcagggcaacaacaacgcgtactgccaggacgacgagatcagctggatcgactgggagaacgcggacgagcagctgctcgagttcgcccgcaagctgaccgcgttccggcaccggcaccaggtgttccagcgtcgccgcttcttcaccggtctgccggtgaccgcgcgcggcggcggcgacccgctgcccgacctggagtggttcaccccggacgggcggccgatggccggcgacgactggggcaacgacttcggccgggcggtcgcgctgttcgtcaacggcgagggcatccgcgagcgcggccagtacggccagcggcacgtggacagctcgttcctgctgttcttcaacgcgcacgacgcccccatcgagttcgccacgcctcccgcggagtacggggagaagtgggagaaggtcatcgaaaccgccgaaccgtccccggatcgcccctcggtcgtcgaggccggccacaagatcctggtgccggaccggtccctcatcgtgctcgacaggacggtgtgatgcgccccagcagtacgtaccgagtccaagtccgtcccgacttcccgctgaaggccaccgccgagatcgccgactatctggccgatctgggcgtgagccacctctactcggccccgttgctgaccgcctcgcccggctccgagcacgggtacgacgtggtcgaccacacccaggtcagcccggagctgggcggcgcggacggcctgcgggcgctgtccgcggcgctgaagaacgccgggctcggcctggtcgtcgacatcgtgccgaaccacgccggggtggccgtcgccaaggccaacccgacctggtgggacgtgctcaagcgcggtcgggaatcggcctacgccaagttctacgacatcgactgggagcgggggaagatcctgctcccggtgctggccgccgacccgggcgcgctcgacgagctcaaggtcgagggcgacgagctggtctactacgacaagcgctacccgatcgcggacgggaccggtggcggcaccccgcgcgaggtgcacgaccggcagcactacgagctggccgactggacccgtggcgactccgagatcaactaccgccggttcttcgcgatcaccgagctggccgggctgcgggtcgaggacccggaggtcttcgaggccacccacgccgagatcctgcgctgggtccgcgagggcctggtcgacggcatccgggtcgaccacccggacggcctgcgcgacccggcgggatacctgcagcggctgcacgacgccgctccggaggcctggctggtgatcgagaagatcctggagccgggcgagccgctgccccgctggccggtcgccggcaccaccgggtacgacgcgatggccgaggtcaacggcgtgttcgtggacaccggcacggaggccttcttcgatacgctggaccaccacctgaccggcgccaccgtcaccttccagaacctgacgcacgacaccaagcaccacgtcgccacccggctgctcgccgccgagctcgcccggctcgcccggctggtccccgaggtcgaggcggcgccgcggggcctcgcggagctggccgcctgcttcccggtctaccgctcctacctgccgggcggtgcccggcatctggcgcaggcgcgcgccgaggccggccgtcggcgtccgcagatgatcagcacgctggaccggctcaccggccggctgcgcaaccccgccgacgagctcgccatccgcttccagcagttcaccggcgcggtgatggccaagggcgtcgaggacaccgggttctaccgctggacccggttcgtggcccgcaacgaggtgggcaacgacccgacccggttcggcgtctcgaccgacgagttccacgagtgctccggcgcccgccagcaggactggccggacacgatgacctcgctgagcacccacgacaccaagcgcggcgaggacgtccgggcccggctggcggtcctgtccgaactgcccggcgactggaccgaggtggtgcgccgctgggtccggctcgctccgctcccggaccccgcgctggcccatctgatctggcaggtcacggtcggcgcgtggccgctgtccaaagaccgattactggcgtacgccgtgaaggccgcccgggaggccgcgacctccaccacgtggcagcagccggacgaaccgttcgagaccgcgctgcgggagatggtcgaccggatctacgacgaccccgacctgcaccgcgaggtgaccgatttcgccgcctcgatcaccccgcccggctggtccaactcactgggccagaaactcgtccagttgaccatgcccggcgtcccggacgtctaccagggcaccgagctctgggactactcgctggtcgacccggacaaccggcggccggtcgacttcgccgcccgccgcgagttgctcggccgtctcgacgacgggtggcagccgccggtcgacgagaccggcgccgccaagctgctggtggtcagccgcacgctgcggctgctgcgccggcggcccgagctgttccgctcctaccggccggtgttcgccgaggggcgcctcggtgagcacgtgctcgccttcgaccgcggcggcgtggtggcggtcgccacccgcctcccggtcggattgtcacgccacggcgggtggcacgacaccaccctgtcactcgacggccacagttggacggaagtgttcacgaataccagctacggtggaaaccgcctggccgtcgccgatctgctgcagacctatcccgtcgctctcctggtgaaagaatgacaaccttcgaggtatgggcgccggagaagtcgcccaagctgcgcctggacgaccaggagcacgagatggagccgggcgacggcggctggtggcgcctggacgtgcccaccgccggtcccggcaccgactacgcgtacgtgttggaggacgtcgccgccccggtccccgacccgcggtcggcctggcagccgcagggtgtgcacgggcccagccgggtctacgaccacgccgccttcacctggaccgaccagcgctggcccggccggcagctgcccggcgcggtgctctacgagctgcacatcggcacgttcaccccggccggcacgttcgacgccgcgatcgagcgtctcgaccacctcgtcgacctcggtgtcgacctggtcgaactgctgccggtcaacgcgttcaacggcgagcacaactgggggtacgacggcgtctgctggtacgccccgcacgaggcgtacggcgggccggacgggctgaaacggttcgtcgacgcggcccacgccaagggcctgggcgtggtgctcgacgtcgtctacaaccacttcggcccctccggggcgtacgcgccgatgttcgcgccctacctgagcgccgggcagaacacctggggcagctcgctcaacctggacggccccgactccggcgaggtccggcggtacatcgccgacagcgtgctgatgtggctgcgtgactaccacatcgacgggctgcggctcgacgccgtgcacgcgctgcacgacgagggcgcggtgcacctgctggaacaactcgcggtcgaggtggagtcgctgtccacggcgctgcgccgaccactgacgctgatcgccgagtccgacctcaacgatccgaaactgatcaccccgcgcgaggccggcgggtacggcctgcacgcccagtgggacgacgacgtgcaccacgcgctgcacagcctgctgaccggggaacgccagggctactacggcgacttcggctcgctggactgcctgcgtaccgtgctggagggcgcgttctaccacgccggcacctggtcgtcgttccgcaaccggcggcacggccgaccggtcgaccggcagcgcaccgcgggccaccggttcgtcgccttcctgcagaaccacgaccagatcggcaaccgggcgatcggcgaccggctcaccgccacgctgtccccgggactgctcaaggtcggcgcgacgctgctgctgacctcgccgttcacgccgatgctcttcatgggcgaggagtgggcggcgagcagcccgtggcagttcttcaccagccaccccgagccggagctggcggccgcggtgcagaccggacgccgccgcgagttcgcccggcacgggtgggccgaggcggacgtgcccgacccgcaggacccggccaccttccaacgatccaagctggactggtcggagctcggcaaaccggagcacgccgagatgctggccctgtacaagaagctgatccggctgcgccgtgaggtgcccgacctgaccgatccctggctgtccgaggtcgaggtgtggcacggcgaccagttcgtggtgatccgtcgcggccggcacgcggtcgcggcgaacctcgccgagacgccgcagacggtgagtctgcgcgccgttccctcggcggtgctgctggccaccgccgacggcgtcatcctggaacgcgaccgggtcgtgctgcccccggaaagcgccgtggtcgtccgcacctcgcgctgacgccacccggccacccccgtcgccgatcggcgcggcgggggtgctcacggcgtaccgctcaatggtgttttgatcttggatcttctggcggttccggggatcgtgaccggtggagcgggtccggcacgatgtggccgtgacgaatgtgcccgacgaccttgtcgccgccgagccggacgagccggggaagcggaaccggtggtatgacaactgcgactgcggtcccgggtgcgatctgccggattgcgacgttcccggctgtgactgcgatggtcccggctgcgatctcttccgattgagcagtctgctgaccgttgtcgcgctgctcgggcatcgatcgaccgaacggcccgcggaacgcctggtggtggccgccatccggggttaccggaaagtgtcgccccggctgcccacccggtgccgattcacgccgacgtgcagcgcctatgcgttggcggcgatacaaaagtacggtctgggcagagggctgcggctggccgccgatcgactgcggcggtgcgggccgcgggtgccgctcgggaccggcgatccggtgccgtgagccgatcgcggccgtccgttcggcatggtgcacgatggctcgatcggggtgtggggggagggtcgatggggtctgtgggacaaccgccggaatcggcgtcggacagcggggcttctccgggcactacgcggattccggctgctccgggtgtttccgggccgccgggcgtctcggctcccgcttcttcgccgggcgggtcgggtgcttcctcggcgggcagggtgggtgcttcttccgcgggcgggtcgggtgcttcttccgccggcgggtcgggggtgcgggactccttccgcggtggggcgctgctcggtgacctggccggcgggattccaccgcagctgcgccgggtgtggaagctgcggcggcggaccgtggaggacatcgccgcgcgcgacatcgcggtgcaggaggcggtcgacgaggggcggctgccactgccggtggagcccgggacgctgcccgagccggagccgctgccggagcgggccgaccggttcaacatggcggcgctgcgactggccgggctggggctggcgctggcgctggcggtcgggatgaccatggtgcggctgctggtgggcgggccgccgtcggtcgccgatctgcgggcccagtccggcgtggacggctggccggtgctgaccgtcggcgtcaaggacgatcagtacgggacggcgtactacaacgagaaaacgaagatctggtcgggattcgacatcgacatcgcgtacatgatcgccgaagatctcggtttccgtcgcagccaggtgcacttctacggcatggagtccgaggaccgggcgcggatgcaggcgaacgacgagaaaggcaatcgcgtcccggtcaagatggtgatcgcgagttacagcatcacaccggaccggatcgccgccggagtgaccttctcgcagccgtacctttacaccgaacagtcggtgatcacgctgaccggacacagtccggtcgccgccctggaggatctgcgcgggcagaacgtctgcacgctgtccacctcgaccagtgaggccgcgccgtcgcgcgtcggggccaacgtggtccgcaagaaccgcgtccgggaatgcttcgccatgctcgacaagcacgaagtggacgcggtcaccacggacgccgccatcctcgccggatggaaagcggaattccccgcgaaatacgcccactgggacctcggactggacgccaccgaggcgtggggcgtgaacgtcggcgacaaccccgccttgaagaagctggtcgatctgacgctgtaccgctcctacgccgatccgcacgacgaccggtgggagaatgcgttccggaacaatctgcaggtcgaggtggcggagaacggcaagacgccgatcgcggtcgccgagcagccccgggtcacccggcccgacgtccggcagctcccgtgggaggacccgctgggatgaccgactactacgccaaaggcccggtgatcgcgccccgccggcggcgcgcccagctcaactggctgctcaccgtcctgccggccttcccgctgatgctgctcgtcctgcgggtctggtacctgagccgccaggacctgccgaccatgctgctgatggtccagtacatcaacccgctcggcatgatcagcgccctgttcatcacgctgagctgggcgatccccgcggtgatcctgatcctgcgggtgctcggcggaatcctgctggtgagcaacccgggcgacgccggacggtcgccgatcgcggtcgccgcgctgcggatgcccgactgggtggtgctgatcgccgtactgatcgccggcttcacctggcagctgcgcctgctgccggcgctggagatgctggtggtcgcggtgctcgggctgaccgcggtgcaacgcctgcgcgtcggacgcccggtgatggcctggaacaccctggtcgtgccgatcctggtcggcgtgctcacctggatcttcgtctggcccggggtggtcagtgcgatccgcggtggcgaacagggcaccgcgctgatgctcgcggtgccgccgctgctcggtccgctgctcaccgggccggtcccggcccgctgggcgcggctggtcacccactggccggccgtggccgccgccaccgcgctgccgatcgtcgtcggcgtggtcttcctccgcgcgccggtgctgccgcgcagcgccatcgaggtcgggccgccggacggcccggtgcgcgaggtgatcgtcgggcagctgatcgcggtcgacgacacctccaccaccatgctgctgtcgacgggtgaggttaccttcattccgaacgggcagatgcgatccaagattctctgtccggagccggtgcggccgccggagagcgcggtggcggtccgcggctggccggtcgaggagaccgtactggaatggatcgcgccgacacggaaggtgaccgaaatcgatcctcgatgcctaggacggccccatgacccggcctgagtgtattttcgactacgacatgtgcgacatgccgcccaccacgtgcagacagccagccatcgacctggcaggctgcacgccatgaccttgcacctgcggtgggcagccgtcaccgatcaaggacacgtccggagcaacaacgaggactgtcattacgccggtgaccggctcctcgtcgtcgcggacggcatgggcggcatggccgccggcgatctggccagccggatcaccgtggagtccatggtctcgctcgacgccccgatcgacaccgacaaccagatggacgcgctgcatcgcgggctggaactggccaatcggcggatcgccgagacggtcgtcgccgacccctcactccagggcatgggcaccacgctgaccgcggtgctcttcaacggcgagcgggcggccatggcgcacgtcggcgactcgcgggcctacctgctccgcgacgggcggctcaaccagttgaccaaggacgacacgtacgtccagatgctggtcgatcagggcctgatcaagccggaggaggcggccgggcatccccgccgggcggtcgtcacccgggtgctgcagggcgagccggtcagccccgcctacgtgatcgtcgagccgcaggccggcgaccggtggctgctctgcagtgacggactgaccgtcgtggtgaacgatgtgaccatcgaagaagagatgcgaaccgttcccgaccccaaggcgtgcgcggagaggctcatcgatctggcgttgcgcggcgggggaccggacaacgtcacggtgatcatcgccgacgtgaccgacggggactgagcaggtattttcatccagccgtggatcatggccggtatcccgccggtcgtggctcacagccggggcatcccctccggccgtggatcatggccggggcgttcctccggccgtgactcagggccgggcatgcctccggccgtggatcatgctcgcggcccggacactggtggtgatcacgacggcgcgcttgatcgggactgtggcgctcgccctcgccgtggtggcggtcggcgagttcgtgggcgcgccccggctctacaccgacaccgcgcagctcgccgcgggcgccatcgcggcgtgggcctgcctggtcgtggcgcgccaccggctcggcatcccgcgcagttggcggcggctcgcggccggcggcctggccgcctggacggcggtccgcgtctggtgggtggtgcaggacgccgccgggcacgaccggctcgcccacccgaccctcttcgacgccggcttcgtggtgctgcccgcctgcatgctgatcggtctgctcacggccacccgcacccggccccgcccgatacccacctcgccgcggcgcgaccaggtggcgctgctcatcgacagcgtgctgatcaccggatcggtgctggccctgggctggtcgctgatcccggcccggacactggacgtcatcgccagctggcagaccctcggctggtgggtggccgcctacccgatcgccgacctggtgctggtcaccatggtggtgctgctgctgaccacccggcccgactcgccggccggccggcggccgctgatgctgatcggggccgggctggtcgcgttcggggtggccgacagcgtacgcctcctcggcctctgccccgcctggctggaaaccgccggccacctgctcggcccggggtgcatcgcgctggccgcgctcagcccggccgccccggccccgaccccggccgaccggacgacgacgcaacgggactggttccacctgctgctgccctacgtgccggtcctggtcaccggcgtggtgctgctggcccgcacggccaccgggcatccgctgacatcgttccaggcctacctcgggtggctcggcctcggcctggtcgtgacccggcagatgatcaccatcctggacaacacggtgctgctgcaccgggtcgcggaaacccaacggcggctgcaccaccaggcgtaccacgatccgctgaccggcctggcgaaccgtgccctgttccgcgaacggctggtcctggccctcgacgccaaccagcacctgggtactccggtggcggtcctcttcgccgacctggacgacttcaaactgatcaacgacacctacggccacgcgatgggcgaccgggtgctgcacgccatcggtgagcggctgcgcgcctcggtccgtccgcaagatctggtggcccgtctcggcggcgacgaattcgcggtggtgttggaccagagcgacacggtgccgccgaccgtaccgcgaccccgcggggcggtgtcggcgctgcggcgggccatgggacggcggcgggggtatgtgctctcggccgccggcatccgcgtctccgcggcgtcacgcgcggcgtcccgcccggacggtggccggcggtccggcgacacccgtcccgcgcgccgccgcaccgacttcccgccggcggcgtccggttcggagtgggccgcttttcccctcgctcccgcagggtctccgaaccacgccgatgattccgccggctccgcccccgctgctgcgggttccgggtcgggggccgcttcgcctaacaccggtgcgtcctcaggttcggtcgccgttccctctgctgcggcctcggcttctgctgtgccctctgctgcggcctcggcttctgctgtgccctctgctgcggcctcggcttccgctgcaccttccgctgcggcctcggcttccgccgtgccctccgctgccacttctgcttccgctgccgccgggccgcgggcggcggtgtcgtcgaacggtgcggctttccccggtgcgggggcgtcggtgaacggcgcgggttccggcggggaggggtggccgtgggtggtggaggcggaaggggtcggcgagcgggtgctggccgccctccgcgagccgtacgtgatcgacggccgctccgtcaccgtcggcgccagcatcggtctggtcgctgccgaacccggcgaccgtctctccgccgacctgctgctacgtcgcgcggacgccgccatgtacgcggtcaaacgccgcggcaagggcgccatgatccgctacaccggcccggtccacggcccgagcgccgacctgccgcaactgctggccggcgcactcagcggcggcagcccggccgcggccggtttcgaggtccactaccagccgatcgtccggctcagcgaccgcgccaccgtggccgtggaggcgctggcccgctggaccgacccggtcgccggcccggtccaccccgacgtcttcgtcaccatggccgaacgcaccggcctggtctccgccatcgacgacttcgtgctggaccaggcctgcaccgacgcgcacgccctcgccgaacggtacggccgtccgatcgccgtccacgtcaacgtctccgccggccgcctcggccagcaaggcctggaagacgccgtcgacgccgccctgacccggcacgcgctgccgcccgaccgcctggtcgtcgagatcaccgagaccctgcgcatccccgacctgccgcgcgccgccgcggtggtcgaacgcctgcgcgcccgcggcgtccgggtcgccctggacgacttcggcagcggctacaacgccctcgcccagctgcacggcctggcggtcgacacggtgaagctcgactcgacgctgaccgacgtcgacaccgccccggaacgagccggaaccctctgccgctccgtcctggccatctgcgcggacctcggcatcaccgtcgtcggcgaaggcatcgagaccaacgagcgcgccgaggccctggcagcgctcggctgcccgctgggccagggatacctcttcggcccaccccgacgtctgtccgaactcgatcaccccaaccgctgacctcccgcccctccatcgaccgtccggctgatctccctcacggatgtacgtcccgcgccgaccgcgcccgcctcaccgcgcccgcctcaccgcgcctgctagctagctaggcctcaccgcgctggctccctcaccgcgccgatcgccttaccgcgctggccgccttaccgcgctggccgccctcaccgcgccggctgccttcatcgcgccggccttttcagcgatgaggcctgatctccctcaccaacctgcctcacttcccgctgcgcaccgtgatgtgtcgatgggtggcggccggtctggtcagccgctgaccggccgccaccgctgtcagggacggcgggcgaagatgtgggtcaaggccgcgaccccgcgatagggatccgtggcaccggcccgggtctcgcagtcgaggatccgcgcgagttcgttgtccgccggcagcggagcgtcatcagcggccgtgtcggtgaagacccggacgccgtgccaggcgaaaacctcaagcccccgcccggccagcgcggcggtcagatcggacagccgatcggcccgggcgcggatgccgagacgattgccgtacgtcgtcgtgccgaacgcctcgcctgccatcgcccagtcgcccagcagcgccggccgcatcgcgagcgcgtcggcgttacggaccagcagggacagtgtgcccccgggcgccagcatccgggcgaggtcggtcagcaacgggccgggatccgcgaagtacatcaacacgccgtggcagagcaccacgtcgaagcagcccggcgagaaggttccggcgagccggctcgcatcggcccggaccgcatgaacccgggagcgcaccgccgtggactcctcgctcagcgcgcgacccagtgccgccgacatctgctcggacgagtccagggcggtgacgtcgtagccctgccgggccagccggatcgcctgcgtgccctgcccacagccgacgtcgagcaccctgggcgcgtcaggtctcaggcgctgcgccagttgccgtgccaccacctcctgccgcaccacttggcgcagtgagccgagccgggacagccaggtcttctccgcgggggtgaacgtgttcgtcatcgttacctctcctctcgaatcacttgcggtcagcacgagcgccaatcggtgacgcccgctcagcgggaacgcacttccaccggcaccgcttcaggtcgcggccgagacggtggcgcggtcggtaggtggatcgggcgtggagcgccgccaccgggtggcggcgatggggtccgttgaaggcgggcgagtagccggcgggcagaggtggcgatcgtgaacggtggagctggtggcatcggtcgtgggcggtgcggtcgtcggcttcggttggtcaacggcgtgggtggtgggcggtgcggtcgccggcttcggttggtcaacgacgtgggtggtgggcggtgcggtcgccggcttcgggtgatcgacggcgtgggtcgtcggcggggccggtggtgcgcggggtgggaaggaccggccgccgtcggtcagcgtggttgccggtgtcatcgggatctcgggttggcccggcgggtgggtgccgcggtcatcgggtcctccggccagggatggcgcggatatcggccccgcatctccgcgcggacctgcggatagccctgcacccagaaggacgcgagatcacgggtcaccgccaccggccgcccggccggggagagcagatgcaacagcaccggcacccgcccgtcggccagccgtggggcgtcccgccagccgaacgcctcctgcaccttcaccgcgagcaccggcgcgcccgggtcggagtagtccagccggatctgcgagccgctcggcaccggcagccgctcgggcgcgacctcgtccagccggccggcgaccgaccacggcatcagccgccgcagcgccgcggtgacgtcgattttggccaggtcggaccggcgcctggcggagcccggatcgatccagtcggcggcgtgttcgagcagcgcggtgtcggaaacgtcgggccacgggtcgccgagcgcggcgtgggcgaaggccagccgggcgcggagttcgtcggcggagcggttccaggtgagcagcccgaggcccgtctcgcggaggccggtcagcagggcggcccgcaccgcggcgggatcgggatcggtcagtcgtctgctgctgagggtgatggcgccgagccgccgcacccggcgggccacgacgtcgccgtcgatccagccgatctcgtcatcctcggcgaacagcgcctcggcgacctcgcgcgcggtcgtctcgtcgagcggcgcggcgctgcggatccgcgcggtgcgcgccccggcggcccggtcggcggcggcgaccgcgagccactagctagctagcggcaggtccgcggcggtcccgccagccatcagataggacgggccacccggctcacgcgccagcgccacccgctcgggataggccaagccgaccaccaagcccgtagccagatcatccggaatccgagccccaggcccagctgcagccccagcgccagccccagccccggccgcacccgcaccggcactcgctcccgagcccgaaccggcggccgcggccgccgctgccggctcggcggcgggggctggcaggtcggtggccgcggcggaggtcaatcggcgtacctccgatcgccaaccggcatcacccgcggcccgggcccgccgcaccgccgccaccagatcgtctgtcgcggatcgcggatcgtcgagcaccgcgatgatctccgcggcccgccgcgccccgaccagcgccgccccgtcgagcaacgcccgggccagccgtgggtggagcccggccccggccagcgcccgtccccgtgcggtcacccgtccgtcggtgtccaccgcacccaggtcgcgcagcgtggcgacggccgcccgcagcgccccggccggcggctggtcgggcagcgccagaccgctgccggacgggtcgccccagagggccaggtcgagcgcgaagccggtcaggtcggcggccgcgatctccggctcggactgcgccgggagccgctcatgctgcgcctcggcccagcaccgataggcccggcccggcgcctcgcgcccggcccgcccggcccgctgcaccgccgatgaccgggacaccgggacggtgaccagtgctcccaggccgcgcgagtggtccattctcggcacccggctgagcccgcagtcgaccaccgcccgcaccccgggcacggtcaggctgctctcggcgagcgctgtggccagcaccacccggcggcgcgggcccgcgcgcagcgcggcgtcctgtgtctcgccggactgacggccgtgcagtggcagcacgtcggcgccgacgccgcgcagccgggtggccaccagctcgatctcccgggcgccgggcaggaagaccagtacgtcgccgtcgccctcggcgagtgcccgccgggtggtcgccgcgacgtggtcgaggagtttggggtcgacgcgcagcccgtgcggtggtgcgaccgggccgggtggcggggaccagatcacctcgaccgggtgggtgcgcgcgtgcgcggtgagcaccggcgccgggctgccgggctggccgagcacctcggccagccggtcggcgtcggcggtggccgaggtcgccagcagccgcaggccggggcggagcaccgcgcgtgcctcgacgaggaacgccagggccaggtcggagtcgaggtgccgctcgtggcactcgtcgaggaccaccgtcgaggcaccggacagctcgggatctttttgcagccggcggaccaggaggccggtggtgaccacctcgatcagcgtgcgccgggagacgcgccggtcgccgcgcaccgcataaccgacgcgctcgccgaccggctcgccgagcagcgtggccatccggcgggcggcggcgcgggcggcgacccggcgcggctcggcgacgatgacccggccggcgtcggccagggcgagcgggacgagcgtggtcttgccggtgccgggcggggcgaccagcaccgccgccccggctccggacagcgtggcggtcacctccggcagcaggtcgcgaaccggtaggtcggggagggcgtcggcgcgaatcagcacgcggacagtctggccgattccaccgacaagttttcgcggcctgtggacagccgccggttatccacaggcccggttccggcgtggcgaaaggtggcagggtggccgtgttgccttttcggtccgccggcgcacgccgcgggcccggcatgttcgagtgatcaatggaggggtgcggtggggatcttcaggcttcgcgggatcaccgggtcgcggcggaggcgagtgcccggtgcctgctgacgacggcacggccgccgaggcgcacgcccggatctcgacgcacatcctcgacaccggcaccggtgatccggccggagacgtctacgtgcggctggaacgccacgacgcggacggctggtcgacggtcgccgagggccgcagcgacggcgacggccggttgcgcttccgggtgccgatgcgcgactggcaggccggtggctatcggctgctgttctacgtggagccctatctcgggcaggactgcttcttcccggagatcatggtggccttccacgtccgtgacccggaccggcagtatcacgtgccgctgctgctcaaccggtacggctacaccacctatcggggaagctgagtgccggatcgcgtggaaacggtcattgcggatgaagtggcccgacctgggaggcgtggcgagcgcaccgtcgcgtgccggatgcggaacgttagggatagatgacggtcatgtgccaagtgtgatcttcttggctctcacggccgctgacgtgaggcggcgtcaccactacgctacgcgggagtaaccacaccgagaggagccgtcaacgatgaccgagatcctgtctgacgcggccgtggcgttcgtcgccgatctgaaccggcggttccggccgcgccgcaacgagctcctccaggcgcgtgccgcccggcgggccgagatcgccgcgggagccagcctgggcttcctggcggagaccgcggacatccgcgccgccgagtggtccgccccgccggccccggccgacctgcaggaccgccgcgtcgagatcaccgggccgaccgagcgcaagatgaccatcaacgccctcaactcgggcgccaaggtgtggctggccgacctggaggacgccaacaccccgcactggtccaacgtggtcgacggtcagcagaacctgtacgacgcgatccggcgcacgatcacgctggagaccgacaagaagacgtacgagctgaacggcggtccgtacccgaccatcgtaatgcgcccccgcggctggcacctcgacgagcgccacctgccggtggacggcgagccggccgtcggcgccctggtcgacttcgggctctacttcttccacaacgcgaaggagctgctggagcgcggcagcggaccctacttctacctgccgaagatggagtcgcaccgggaagccgcgctctggaacgacgtcttcacctatgcccaggagcagctcggcatcccggtcggcacgatccgcgccaccgtgctgatcgagaccatcccggccgcgttcgagatggaggagatcctctacgcgctgcgcccgcacatctccggactcaacgccggccggtgggactacctgttcagcatcatcaagtacttccgggacaacccgcggatgatcctgccggaccgggccgcggtgacgatgaccgcgccgttcatgcgggcctactcggagctgctggtctccacctgtcaccggcggggtgcgttcgcgatgggcgggatggcggcgttcatcccgagccggcgcgacccgaaggtcaacgagatcgcgctggccaaggtcaacgaggacaaggagcgcgaggccggcgacggtttcgacggttcctgggtggcccaccccgacctggtcccggtctgccaggcgatcttcgaccgggtgctcggcgacaagccgaaccagctgtcgaagctgcgccccgacgtcgccgtcgacgcccgggacctgctcgacgtcgcggcgctggacgcccaggtcaccgaggccggcctgcgcaacaacgtcaacgtcgcgctgcaatacctggaggcgtggctgcgcgggaacggggcggtggcgatccacaacctgatggaggacgcggccaccgcggagatctcccgctcgcagatctggcagtggatccacaacggggtcaagctgcccgacggcaccccgatcaccgcggaactggtcacccggatcgaggacgaggagctcgccaagatcaaggagacggcgggggagggcggccggttcgacgacgcccgcaagctgttcgagcgggtcgctctcgccgacgacttcgccgacttcctgaccagcgcggcctacgactcgatcgactgagccgacgagcgccgggagcgccgcgttcctccggattggctccgggggaacgcggcgtctcgtcgagggactgttcataacgtgatagatcggcgttcgtcgaatcggtgcggacctcgaactccggcgggccggatacgtatcaccggatatgagccggcgcgggaagcgccggtggcgccgggaggcgatcaaggtgcgacacgaacccgtacgagtctggtatcggccctggaagatccgctgtcgctgcggctgcgagtggtatccctgccccgacgcggcgaccgccccaccgcccgcggtggcgcacagcctgcatctggacgaatctagagctgaactttctcccggacccactgcggatccggattgacgaaaccctcaccattgatgaccacggtcgggaccgtctcgttgccgtcggcgaaaccgcgcacgatcgccgcggccgccgggtccgcccagatgtcgacccaggcgaagcgggccgcgtccggacccagtcgggcccgcagccgcaggcagaacgggcagccgggccgccagtagatcaccgggcggccgttggcgacgccggccgggcgcgggaagaccagcggtgacgtcaccaccgccagcaccaggaagaccgccagtagaaccgcggcaccgccgggtgaggcaccctgcgcgatcttgaccgcggcgatgatcacgccgcagaccgcgctgagcgcggcgagccgccaccttcgcgtcatgcgcggaagggtacgccacagggtcgccaccttccgcccggaggggtgcagcacgtggcaagagaccgcggcgccgatccgcaactccgcgaagcgcggcgagtcgatccggaaccccgcgaagcacggcgagtcgatccggaactccgcgaagcacggcgagtcgatccggaactccgcgaagcacggcgagtcgatccggaactccgcgaagcgcggcgcgtggatccggaaccgcggcgcgtggatcggaacccagccaaccgcagcgcgccgatccggaacgttcatgggacagaatggggcggtgccccgaaccgtgaccctggtgctggtcgacccggccggtgacctgctcggtgcgatgccgccgttctccgtcgccagcccctggtggcaggaggtggccgaggtggtggcggcggccggcgccgaggtcaccgtcctgcgcctgctgcacgccgaccggccggcgccgcccggcgggcacgtcacctacctcgccgagacccgggctcggcctgccgggctgaccccgctcggcgccgacctggtgccgcacgccctgcgcgccccgtgggccgagccgggcggccccgccgtgacgctggcctgggcggccggcgtcctggaccggctcgggtttcccggcctgaccgccgtccagcagcgcacctggaacctgtcggcgatctggcggatggacggcccggacggcccggtcgcctggctcaagcaggtgccgccgttcctcgcgcacgagccggccgtgctcggcctggtcgtcgaggtcgcgccgagcctggtgccctacgtgctggccgccggcagtgcggggcggatgctgctggcacacgtgccgggggaggaccggtacggcgccggcgccgacctgtgcgcccggatcgccgaggctttccacccggtgcaggagcactacgccggccgtgtcggcgaactggccggtgtccccgaccgtcggctggacgccgcgcggttcgccgccgtcgccgcgccctacctgtccggcatcccgggcctgaccggcctgatcgacgacctgccgcgccggctggccgccgtggccgcctgcggcctgcccgacaccctcctgcacggggacctgcatcccggcaacgtccgcaccgggtccggcccggacagcctcgtgatcgtcgactggggagacgcggcgatcggcaaccccgcgttcgatctgctgcgtctcgtcgacgggctggccgatccggagccgatcgtcgcggcgtgggcacggcgatggcgggtgacggtgccgggcagcgatccggagcgtgctgtcgagctgttgcggccggtcgccgggttgtggaatgccgccacctacgccggtttcctcgccaacatcgagcagtcggaatggccctatcacgccggcgacgtgccggactgcctcgccgcggcggtcgccgcagccggagcgtgacgccggcatcgatgagtacggtgtgctgcatgacggatctgcggcggcgctatatcgatctgatccggcaggacggcgtgtccctgtcgccggagttggccacggccttcgggtcggtgccccgggagttgttcgtgaccggtggtttccaccggcgtgacggcagctggatggagccggtcgacccggatttcctgcccactgtctacagcaacgacgtcctggtcaccaaggtggacggcgaccggccgatcagctcgtccagccagccctccctgatggcgatcatgttggcggccctcgacgtccggccggggatgcggatcctcgagatcggcgccggcaccggttacaacgcggcgctgctggcgacgctcggggcggaggtgaccagtgtggaggtgcaggaggacgtcgccgcccacgcgcgtgccgcgctggcccgggcggggatctcccgggcgcgggtcgtcaccggtgacggttatccgggatctcccgatgcccggtacgaccgggtcatcgtcacggtgggtgtcgccggcctctcaccccactggttcgcccagctggacccggctggcttcgtcgtcgcgccggtcgagcacgccggccaccatccggtgctgacggtaaccggatcgggcaccggccgggtggtctgctcggccggtttcatgggcgccgccggcccgctcggcgcccgccacccgggcagccacccgcccccggccggcgtactgcacggcctgaccgaaaccgccccgccccgctgggatccgccgttggacagcacggcctatcgggatctctggtacgcggccggcgcctgggaccgccgggtcacccgcgccacccttcccgcgggggaggtcgtccgccgggatgcccggcatgccttccgcagcggtgaggacatctacctgaccctgctcgacgagaccggaaccggtggcgcggtgctcctcccggacggctcggtgctggccggtggcggtgacgcggaccggcgtaccgccgacgccgccgccctgatcgaccgctggcatcgccggggtcgtccgccgatgcgcgcctggcaggtcggcctgacccgggccggcgacccggatgccccgatcctggtccccacgacgtggcagcctgccgacgactaagagcgacgtggcagcctgccgacgactaggagcgacgtggcagcctgccggcgatcaagagcgacgtggcagccggccgacgatcaggagcgacgtggcagccggccgacgatcaagaacgacgtggcagccggccgacgatcaagaaggacatggcggccggtcaggagcgggcgcccaggtaggtcagcaccgccatgacccgccggttggtgtcgtccgtcgggggcagaccgagcttgcccaggatgttgccgatgtgcttgccgaccgcggtctcgctgacgaacagcgccgccgcgatcgacgagttcgaccgcccctcggcgatcagccccagcacttcccgttcccgcggggacagcccggccagcggatcccgtggccggtgcagcaggcgccgcaccacctccgggtcgaccacggtcccgccggccaggacggtacgcagcgccgccacgaagtcctcgatgtcggcgacccggtccttcagcagatagccgacgccgtcgccggtgccgatcagatccgacgcgtactcctcctgcacgtactgactcagcaccaccaccggcaggccggggcggttccgccgcagctcgaccgccgcccgcaggccctcgtcgtggaagccgggcggcatcttgatgtcggtgaccaccagatcgggctggtgcacgccgaccgaggcgatcaggtgctcggcgtcgcccaccgcgtccaccacggtgaagccgaaccgcccgagcaccccgatcagcccctcccgcagcagcaccccgtcctcggccagcacgacccgggcggcggcgcttgcgttcaccgcgggcacggcagctccacccgcagcagcgtggctagctagctagctggccagcagcagcggccccggcggcggccacccggtccgcgagtccggtcagcccggtgccggccgccgggtcggccccgccccgcccgttgtcctggatctccagatcgacgcgggtgccgtcgccggtcacccggacccgggcggcggtggcccgggcatgtttggcgatgttggtgagcgcctcggcggccacgaagtacgccgtggtctcgatcccctcgggcggccgcgccacgatgtcggtctcgacggtgaccggcaccggcgaggtggcggccagctcgcgcagcgccgccggcagcccgagatcggtcagcacctgcggccggatgccgtgcaccaggtcgcgcagcaccaccatcaactccttcgcctgggtgtgcgcctgcccgagcgggcccgcggcgggcgagtcctccggcaggtcgagccgggccatgccgaggtgcagggtgaggctggtcagccggtgctgggcgccgtcgtgcaggtcacgttcgatccggcggcgttcggcgtcgaacgcgtcggccagccgggcccgcgactgggccacgtcgctgagctggtcgcgcagcgggtcaccggcgccgagcagccgccgggccagcatcgcgtgcccggccgccaggatcccggccaggtagagcgtgaccggggccagcaagacgccgagcacgctgagcgggatgctgtgcgctccgccgtgcacctgccagttgccgaactcccaggtgccgatgccgaacgggctggccaccatcagcgcctcgacggacacccagagggaggcggcgaggaagaccggcggggcgagcagggccagcagcacggtgtagagcaccgcgcgccaggtcgcctcgtcccggagcgcggcggccggtccggccggccgggtgcgcgcagcgggcgcgggtcgaccaggcgcagccggcggcgttccagcgcggcgaccggcagcgcgatcagcggggcggcgacggcgagcatcccggcggcgatcacgaccaggaagacgacggccggccggggcgggtgaccgtgcaggatctcgcggccggcgaccagcagcgggagcagcagcacggtcaggccgcaactgagcggcgcggcgacgacggcggtcacggccaggtgggtgaccgagcgccagggccagagggtgagcagatagcggcggtcccggagggcctcgctcagggtggtggcggacacggtttcaccgtaggcagccagccggtcgcggcccatcccgctggcccgagtcctggggtgtggctggatatacctttcaccaccggccggcccggcgatcgcgccagggacggccgtccgggtcgtagatcaggcggtacgcgggggtcgcccaggcgcgctggtaccacgggaggcgttcggtctggtgcgggatcaggtgccccggcgggcgcggcccgtgccggccgttgtcgcgccagtcgcgcagcgccgcggcggccgcgtccatccttcgtacgaccgcgatcggatcgatgagctcggcggacccggcgccggcggggaggcccagatgctcgcgcgtcagcgcgagtcgcagatcgcgggggaaacgccgggcgccgtcacccagcccggccgggtcggccggctcgcgctcgtcgggcgtgtcgtcgaggatcgcgcaggacagctcgctgtcgtgggtccatgaccgacggttgaagttgtcgctgcccacgctgcaccagatgtcgtcgatcacgcacaccttggcgtgcacgtagatcggcgtgccctcggtgttctccaggtcgaacacgtgcacgcgatcgggcgcggcgtgcttgcacagttcgatggcctgctcccggccgaccaggttgggcggcagcgcgaagcggccgtccacgtccgggtgccgtggcacaaccgcgaccaggtgcagctcggggttggtctgcagcgcctcggcgaacagcttggcgacctcggccgaccacagatactgatcctccaggtagatcagtttccgggcgcggcggatcgccttggtgtagccgcgggcgatgctctgctcgccgagcggcgcgaaggagtatttcgggcgcatcgccgggtacgtccgcagcacctgcacggtcagcgggccacactccggcgggtccggcggttgcggcggcagatgatcggcgtccagatcggcgtgattcagcaggtcgatggcggtggagatcggcccgtgctgatcgagcggggccgggtcacgccagcgttcccggaaagtgagatcgagcgcgccgaccaccggaccgtgcagctccagctggatgtcgtgccagggcggggtcggcccgtacgcctttgccatccgcaccgcctgcggatccccgtgatgatcgtcgtcgtcgcgacggctgtggcacaggtcgatgccgccgacgaacgcgacgtcgagcgccggctgcccgggatgccgcaggatcacgagtttctggtggtgtgagccgccgcgccggacccgctggtcgagcagcacctcgccgccggcctcccggatctggtcaccgaggttccggttctcctcctccgaatacgccagcttgtcgaggtgggagcgccacagcaggcccttgacgatcaccccgcggcgggcggccgcggcgaacaactcggcgatcgtcgggccgccgtcgaccgccaactcgtccgggtcgccgcgccagtcggtgaagaacaggtggtcacccgcctggagcttctccacccgctcggtcagccgggcgaagtacctttttccgtgaatcaggggttcggcggtgtttccagcggaccacgtgggtatgccggtgtgcgggttgccgcgttcggcggcggtcagaagccagtcctccaatggcacgggcaacccctctgaggtcgatgatgccctcaccgtaagccccctgtccgccgcgcgcatgtcgcgatcaccccccgatcgtcgcgttccatctgcggaggaaaacccgtcatgagcagtgagccgctgaccaccgacgtcgtacccgaagtcgccgaatccgccgagaccggactgctcgtcacgatgctgctgctggtgcttttcggcaccgcagcgatgctttacctcttctgagagctcgtcaaacaaggacccactcgtcgtcccggatgatctctaccgtccctcgcgggccggtgccggtcaccgtgatgccggcgccgcccaccaccacgtcggtgtgcaccccggaggagttcagccccagctcggcacgctgctccggggtcatcgccaccccgcccggcacggcgaacgggaaactctgcccccacgccacgtggcaagcggcgttctcgtcgaagagcatgttgtggaacagcgtgccggtccgcgcgatccggctctccttgtcgaccagcgacacctcgcccagatgacgcgcacccgggtcggtctccagctgggcccgcaccacgtcggcgccctcgtccgcggtgaccgcggtgatccgcccgcccgcgaaggtcagccgcagcccggtgaccacccgcccgccgatcgccaccggcttggtgacccgcagcgtgccgtcggcgcgccgccggtcggggctggtgaacacctcttcggtgggaatgttcgccaggtaggggatgccggcgtcgtcgatcatgccgcccccggtccagtggcagccggggatcaggccgaccgtgagatcggtgccctccccgacatagcgcacctcggtcagacccagcgcgtccagcgccgtcccgcgctcggccagcgtcgccgagcgctgccgccacgcctgcaccggatcgtcctcgtcgaggcgcatcgcgatgccgacggcctgccacagccgctccaggtcgggctcgccgtagacctgggtggcccagccgggattcggcgcgccgaccgccgtccagcgcagcttgccgatcatcgcgtcgcgccgggcgaccatctccccggtgcggatcgcggcggctttcgccggatcggcgccgtcgagcaggtgcgggtcggcgtcgccgatcagggtgatccaggcggcgccctggtcggcccactcgcggatgcgctgcagcgcccacggccgggaggaggtgaggtcggccagatcggagtggtcgaccgcggaccggcgcatcggcccgtcactccacaccggctcgacccaggccgcgccggccgcgtaggccgcctcgaccaccgcccgggcgacctccagatgggcggtgtcggtgttgagcacgacaccctgtccgggttggatgttgacccctgcccggaccacgacctcggcgaaacgcggaatccagtccatggccgagagcctatgcctgtggagccgtcaaccgcggttgacatgtggatggcgtcaacgtaagttgacagcatgaccgaggcaaccgacctcgccgccgccgcgagcagcgccgacccccgggtcgggctgcgcgccgtggtggcactgcgccgcctgctggagggcctggagcacctgcaggtggccaatgcgcgcaaaagaggctggtcctggcaggagatcgccgacgtgctcgaggtgacccgccagggcgtacacaagaaacatgcgcacctgatgccgatgaccgatccacgggagggctgagatgttcgagcgattcaccaaggaggcccgcaccgtcgtggtccgcgcccagatggaggcccgcgaactgggccacacggtgatcggcaccgagcatgtgctgctcggcctgctggctcaggacagccgggccgccgcggtgctgcaccgggccggcatcgagcgcgcccgggtccgggacgccgtggtgcgcgccgtcggcgaccgcaccgacgaggccgccgtcaccgccgaccaggatgccgaggacgcggccgcgctcaaggcgatcggcatcgacctggacgccgtccgggccgccatcgaggagaatttcggggccggctcgctgcgcctgccccgcccggcgccgaagaagagggggatcttcggcaaattctccgcccccaccaccggcggccacatcccgttctccaaacggaacaagaaggtgctggagcttgccctgcgcgaggcgttacgcctcaagcacaagttcatcgcacccgaacacatcatgctcggcgtcatccgcgagggtcagggcctggccatgcggatcctcgccgaccagggcaccgacttcgaccggctccgcgccgacctcgaccgctccctcgaagccggcgccgccaaccgttcctgagccgcattccggggacggggaacgatcagcggcatgcgccgccaccccctcacccactgaccgcggccggtccaggccgtcgattgcggcggtacgtcgtgagcaccacgccggtgcccacgacgtaccgccggatcgatcaatcggtgtgcggcagccggctcgccggaatgacgcccagccgacccttctgaaagtcctcgaaggcctgctgcagctcggctttcgtgttcatcacgaacgggccgtagtggaccaccggctcgcggatcggccggccacccatgatgaacaggtcgagctcgctcttcgcctccacccggatcgcgtcgcccgccccgaacgtggccagctgaccgagtctgatcggccgcatgtcggtgcccgcccagccctcgccggagagggtgtagaccagcgcgttgtaatccggctgccacggcaggtccagtcgcgccccgggctgcagcgtcacatgcgtcaggttgatcggcgtgaacgtcgaccccggcccggcgtgcccggcgacctcacccgcgatgatcctgatcagccccccaccatccggcgtggtgaccagggccgactccctaccgcggatgtcctggtacttcgggtcgatcatcttggccgcggccggcaggttcacccacagctgcagaccgtggaacagcccgccgctggtgaccaggtgctcgggcggcgcctcgatgtgcagaatgccgctcgccgcggtcatccactgagtgtcgccgttggtgatcgagccgccgccgcccagcgaatcctggtggtccatgatcccgtcgatcatgtacgtgaccgtttcgaatccccggtgcggatgccacggggtccccttgggttcacccggcgcgtagtcgatctcacccatctggtccaggtggatgaacgggtcgagctcgctcagcggcaccccggcgaaggcccggcgcaccgggaaaccctcaccctcgtacccctgcggcgcggtcgtcaggcggcgaaccggccgaaactccgtcgcgaccgggtccagcttcggcaggcgcggcagaacgagaacgtcatcgacggtgattgcaggcatttcgagccctcctgacttcgaggtctccagcgtagctccttcaaatctgaaataccagagtttcgcttcaaatctgaagaacccatgatgcgcgtccggggtcgggtctacctgtggtcgccgcccgcaagatcgaggatgccgctgagcagcccagggttggcggcgatcgtcgcggacgacgcgaagctgtggggcgagccgtcgcggtcggcgatcagtgcgccggcctcgcgcgcgatgaccacgccggccgcggtgtcccacggcttgttggccagcatgacgacggcgtcgacccgaccgatggccagccacgccaaatcgatggcagctgatccgtgcatccggacacgctgcacgctcgcggcgagccgttgcgtgactgcgaacctcgcccggttcttctcggcggcgtcctgcccaaccgcgtagtcgcccagcgccaccaccgcatcgctgattcgctgcgtcgtgctgaccaggatgggctggccgtcggcatgggcgccgttgccctcggccgcggagtagcggctaccgagaaagggcaagtcgatgacgccgagaacggagcggttctcggtgatcaagccgagcgagacagcgcacagcggggaaccgtgaacgaagttgacggtgccgtctaccgggtcgagcgcccacaccagcctctccgttgtcccgctgaggccgttctcctcaccgagaaagccgatctctggaatgcgcttggcgaggaaggtccggacctggtcctcgatcgcgtagtccacctcactcgccatgtcgcggtcgcccttggcggtcagtgcacccggttgcatcgtgcgcatgatcttccgtgccaggtcaaccgcctgatgggcgacgggaaggaggtctgtgtagtccgtcatcatcaccccgacttcggccggctgctgcccgacggccggtcgttccgcgtcgtcccgaccgagccggtcgacatcgcctgacacgtgtcgctgcaacacgccgagccgtatctcgccgcgggcaagcagatcgcgggaggcttcgtgcaccacgtaccgatcatcaccgagggcatggccgacggctcggccatgggatacatgctcccggcgttgcaggccaccggctacttcgtcgaccccgagtgccgggtcggcgaggcgaagtcctgttgcccgccccacccgggaatctgaaaggccaactgatcgatgcgcattgactggactgcactgcccgaggcggtcacgacgaaggtagccgcccgaatcggcggaacgcacgccgtccccgccgaggccggcgaccacgcggagatagccgcaaccgtcagcgggactgccgggaaggttttcgtcaaggcggcctgcaccgagttcggcgtccggtcactgcgctacgagctgcgggtgagtgaggccgtgaaggggcctcactcgcccgcggtcgaatggcacttcgaggcggccggctggctggtcgtgggcttcgagcactgcgacggcccgcacgccgacctgtcaccggggagcccacaccttgatcttctggctgaggcgctgacagggctcggcaagacactggcgcccgaggtgccgctgttcacgccgacgggccggctcgggttcccacatccggcgatggacggtgacgttctcgtccacagcgacctcgccccgaccaacttgatggtgagctcccgcggcctgttcatcgtcgattgggcattcgccaccagagcggcgccctgggtggagctggcaatgctgacacagtggttgatcggtagcggccacacgcccgagcaggcggaacactggctggcgcggtttcccgcatgggctgaggtcagcccggacgtccttgacgacttcgcctcgaagaacgcaacgaagtgggcatcgagagccaagcccggctcgccggcctggatgcacgacctcgcggactggaccgggcagtgggcaagtcaccggcgtgcggcggaggagacccggatcgtgacgatcccgcccggcccgcggcgggcggtcaaggcggatcccggtgccggtctggggaccacgccgccgaggtgatgccgctgctcaagtcggtgagcgtgcacgccagccagacgcagcaggcttgtggactgccgacgaccgggctgccgctgaacccggacggggagcccggcgcggccgccgacgacgcggcaccggcgggggcggatcagcaggccgaggccgagcggcaggcgcaacaatgccaggagtcgatggacccagctcagtcagaccctgatcgcgacccgtcaggagcgggactccaggatgaccgacctcctcgacccggagagcgacctgtccggcacgcaggcggccgtcgatgcggccaacgggcagctgcacgagatcatggaccggcagacggatctgcagcagtccgccgagtgctccggcacccacctcgaccgttggtactactgatcccgcaccgggatgccggtgcgggatcgggaaccgcgcggaccggtgtcagctgggcagggtgacctggcccggggtggtgcgctgagtggtggtgccgtcgccgagctggctgttggcgttgttgccccagcaccacaggctctggtcggcgcggaatccgcacgtctggtagccggtggcgtagtcgccggtccaggtggtggtggcgccgacctggaccggggtgccgcggttgaccgtgctgccgtcgccgacctggccggtggcgttgttgccccagcaggacagggtgccgtcggtccgggcgccgcatgcggtgttgaagccggcgtccgccctggtccaggtggtgccgctgccgacctgggcgggcgcggtctggtacgtgccgcccgcgccgagctgaccgtagccgttgtcgccccagcaccacagggtgccgtcggtgcgggtggcgcagttgaaggcgtagccggcggtcaccgtcgcccagttggtggcggtgccgacctgcgccggggtgaccgacggggtcagcacgccgaggccgagctggccgtcgccgttgtcgccccagcaccacagggtgccgtcggtgcgggtggcacaggtgtgtgcgaaaccggccgagacggtcgaccaggtggtggcggtgccgacctgcagcggcgtggtcgcggtgtacaccgacatgccggtgccgagctggccgagccggttgaagccccagcaccacagggtgccgccggtgcggacgccgcaggtgtggctgtcgccggtggtgacgaccgcccagtcgctgtcggtgccgacccgggtcggcgtgttccggctggtcgtgctgccgtcgccgagctggccgcgggtgttggcgccccagcaccacaggctgtggtcggtgcggacgccgcaggtgtagctggtgccggcgtcgatggcggcccagtcgccggcggtgccgacccgggtcgggctgccgtggctgacggtactgccgtcgccgagctgacccttgctgttgccgccccagcaccacaggctgtggtcggtgcggatggcgcaactgtgcgcatatccggcggcaatccgggaaagggcggccgtgggggcggcgccggctggtccggcgggcatgccgaacaggaaggcggcggccgtcgccagggcgaaggctgcccgtcgccagcgggccgggggcggggcggcctgcgtttcgctcatctgccgatcactccaaacgttgtcgacggtggcagtgggagcgctcccacacgtgtaacaaagttcataccatcgacgatcgatattgactaggagcgatgcgcgtcgctgatcttggcgaacgcccggccgatcaccgccagctcgtcgggctccagccggtcgatgaatcgccgtcgaaccgtttcgaggtgcgccggggcggcctcgcgcagcgcggtcagcccggcatcggtcaggaccgcctcgtagccgcgcttgtcgtccgggcagctctgcttctcgacgagtccgcgtttgaccatcgaactgatctggtaggtgatccggctcggcgacagcaccagccggttcgccagctcgcccatccgaatccggcggtccggagcctcggcgagcgcgacgagcacgtggtagtcgttcatgctcaggccggtcgcggcgcgcagctcgtcctccagtgcggtgtgcagcgcccacgagctctcgatgaacgcgcgccagtgctgcatctgggtctcgctgagcggttcggccatggcgggaacgatactccttcaaatcttaacttaatagtcaacatcatggtgtacgtcgatggctgacgacctctcgtcccccgccggcgccgcacgctgcgccggccggcgggcacgatccgtccgcgagccccgccgcacgccgcgccggaagctggccggaggcgatgtcgccgaatggtcatcaatgatcgtgactgttcacgactctgcgccggcgagccgcgtatccggtagtgggcgctgaaatcggcgattcgggaagtggcgcggtaaatccgcgtaaccggagattcgcttaccggagaatcagttctgacacccgcgtaccggaaaatgtgtgccggaaaaccgcgtaccgggaaatcggcgggaccgtgagtggccgcgaccggaagaagcggcaggcgaaaggccggccccggagggccggcctttccgcgatgatcgcctcggcggggagccccgccgtgctgaggaaccggttatgcgaagcgctggaaagcgggcagcgagccgagcgaaacggtcagctcgaccgggtggtgcaccagcgcggcgaccgtgaaacgggcgccgaacgggtcgcggagctcggcgaattcggtcaggccggcctcggccggctcggcgatcagggccccgccgagacgctcgcagcgtgccgcggcctccacgatgtcctccacctcgaacgccgcccgccaccaggcgccccggtagcccggggtgagtccggcgatcgcgtcgtgcgcctggttcagccattcgccgacgccgaagtcgtggcgcagcagccagccgaacgcggacccgtagaaccgggcggcggtgtgcgtgtcgtcagtgatcagttccggccaggacatcgtgccgggctcgccgccggcctgcgcccccgcgaagtcggacggctcccacagcccgatgaccgcgccggccgggtccgccacgatcgcccggcgccctccgtgcgcgtcggccgggtggctcaggcaggtgccgccggccagtgccacctgctccagggtctcctccaggtcgggcgtgctgagatgcgtcagccacccgtccggacggtcggacccgctgcgggtcaggccggccacggcccgcccgttgagcttgaagcggtcaccggctgactcccagccgaacaactctccgtagaactgcgccgctcgcgcagggtccgcactcgccaactccacccaacagggtgtcatcggtgcatagcctctgatccgcatgtgccgctccatggtggacttccccagttgcttgagcactctacggcactgaatacgcatcgtcactaccgcacggttcattgtccggtttagagcagaaatgaactactgagcgtaagtgtgcgagtgaatcaggtgatcgtcggcaagcgagttaaggcggcgttcattttcaccgtgcgtcacctttgcggcgagggcgtgcgctgtcactctctgttgagcagcatctcgaaccagaccgtcgaaccacgcaccgtggggtcggtgccccacgagtcgctgagatcctcgatcaggccgagcccgcggccgcggctcgcgagcgtgtcggcccgtgcccggatcacgctgccccgggtgccggtgtcggccaccgagaccagcagacgctccagattcaggtcgatgtgcacctgcgccggggtcccggcgtgcagcagcgcgttggtggtgagctcgctggtgcacaggatggccgcgccgatcaccggctccggcacctgccactcgcgcagccgggccgacatccactgccggacccggctcggcccggtcggctcggcggccacatgcatcgtcgccgaccggctcatggccagcgcgtgctcgaccgcgagcaccgccacgtcgtcgtcggtggtgcccgcgaccgcggcggtggccagcgagcacatgttgcgcggatcgccgctggccgacccggcggcggccgcgaccagggcgtccaggccggcgttcaacgcgtggccgcggcgctcgacgacaccgtcgctgtacatcaggatggtgtcgcccggctccagcgtcagcgttccggtctgccagcggccgcccagcccgagcggggcgcccggcggcaccttgaccagctccgcggtggccggcccgccgccgaggccggcccggcgcagcaccggcggcggatgaccggcgctggccagcgtcaccgacccgtccgccggatcgagcacgccgtagacgacggtcacgaagatctcctcgttccgcgactcggcacccagcgagccgaccagccggtccagcccggccagcacgctcggcggggccggatcggtcagcgccagcgcccgcagcgccgcccggacctgccccatcaccgcggcggcccgcacatcgtggccggccacgtcgcccagcaccatcgccagccgaccgtcgagcaggcggaacgcgtcgtagaagtcgccacccgcggcgttgccgtcgacgcccacgtcatagcgcgcggcgatccggaacgtgtccagctcgggcagatgctcgggcagcatgctgcgctgcagcaactgggcggtgccgtgctgcgcctcgaagcggcgggcccgctcggcggcctgcgccaccagctcggcagcggcgcgcagcagggcacgctcggccggcagccaggcatgggcgcggcggaaccccatggtcagcgccccgcgcacggacggggtgcgcaacggcagggcggccagggagcgcacccgccgctcgtgccggtcctgcgcgacggcccgcagcggctcgccgtcggcgacgaaggtcgccgcgccggtctccgccgccgcgaccagaggcgcggcctggtcggcggcgatccggcgccagaccggggggaggcgctcgtcggcctcgtcgagcatctcgccgcggatccggcggacgaaacggtaggccgtgccgtcgtcgacggccagggcgcaatgatcaagatcaaaggacgccatggcgtacgtcaggacgacccgcgtgacatcgtcgatggtgagagcgccggccagccgtgcggtcagctcacccagactctgcagccggtgcaccacctgggtggtctcggcggccacggtcagcaccccggcgatcgtcccgtgcgagtcgcgcaccaccgaatgcccgcgggtgtagaaggccggctccgcgccacccgggcgcagcgtgacctgactctccggctccagcacggcgtggccggtgcggaacacccggccgatcacgtcgctcatccccggctggtcccaggcctccccgaacgcctgcacggccggccggcccagcgccaccgggtgccggccgcccagcacctcggcgtaggcgtcgttgtagagcaccacgtagtcggcgccgcagaccagcatcatcgcgaccggtgactccagcataagatcgaccgccgtgcgcaccgcgtgatcccaccgctcgagcgggccgagcgaggtgcgcgaccagtcgaaggcatgcaccagggccgcgcagcccttcgcaccggcggactgcacgggcagcgtggagatcgctggcgggcgtgccgctcccgagccgaccatgcggaaagcctatcccggctaagccgtttgtacgatgtcgcaccggccgaccgtccgattcttgacgatctgcgagacagtcgccccgcactgcgtcaccgtgcgtgatctggcgtgtgacctgcgtgttctcagatcatttatagtcgccgccgtgactggtgacaccacgggggagcccgtccccggcagcgaggcgcaggctcccgtcgagggcgggctggacgggtggtccgcgtcggcggagacggccgcggtgccggcgccggcgccggccgaggagatcctcggattcgccgcgacctcggaaccgtatccggtggtaccgcggctgcggctcgtggtcccgccggcctccgccacgcccggcggtccgccctcgggcgttgcgtcggccgctgtcgcgatcgtgcgcggctggctgtcccggcgccggccggtggtggcggccggcggcgagacggccgacaccgggacgccggcggtgctgagcgcggtctaccactacgacgacggcagccaccggggctcggtgcaggtggtcaacgccggtggcggggaggcggcggactggaccgtcacgctcagcgtgccgggcggcgagccggtcacggtgacctccggggaggtcgcggtggcacagtcggggacggtcgtcacgttccggccggccggtgcggcgctgggcgccggcgacacggtcaccttcggcttcgggttcgcggcggcgccgacgagcgctcccgtcggatgtgccgtgaacggttccgcccgctcctgacgtcggccggcgccgctgaggccggggtatcgcggagcacgcgcaaggcggaagggccggcgctgcggaagccggggtgccgcggagcgggagcacgcgggaaaggcggaggggccggcaccgccggggcggtgccggccccggggcacggctgttccgatgatcaaggctggccgggcggcccggtgatcaggcgggcatgcccctgcgcgaaggggtcagcgcgggttgggcagcgtgcgggcgaggctgcagacggcgagaaggcgacgcaggacccagtcgttctcggaccagtcgatctcgccctcgggggccacccagccgtgctggaacgcggcgtcgcggacgccctcggcgtaggcggccagcaggatcggggtgagcgggcgggtgtcggcgtcgaggctgtcgcggacgccggccgcgtgctggtcgatgacggacatcaggcccgggttggcctgggcggcggcgagaccgctgacgccgacggcggcggtcaggtcggcgagcgaggcgtgcgcggagcggagggcagcgcgggcggcggcgttgctgaagagtccgttcatgagggaaaagttagagactgcggggtagccaacggttctccctaacggtgcaggacggttgaactcgtcgcgcggttcccggtgggtcggcgatgcgtccggatcggccggtggcgcggcgttcgcggaggcccggaccggggtacgacagccgcgtccggcgaggcagacggcgaggcaggcgagggagaacccgatgacgggtgggaacgggacggccgcggaggcggcacgggggaacgggacggccgcggaggcggcccgggagagcggaccggatgcggcgcatcggcggcccgacggcgtggacgatgtgaccgtcgaagccctggggaagttgagcgaggcgctggagaccgtggagcgcgtccgggggcacctgtactcgctgcaccagctgatcgggtcggcggacttcaagctcgacgaggcggtgtcgctgttcatgcagggtgggcagaccgcgatcgcggagcggatcgagcgcgagctcatcgggcgcaacgtcgtgccgggtcggtggacgtttcagctcgtcgaagagttcgatgacgggtattacagcgagttccgccggctggagcgcgaggctcgggaggaactcgtgggcgggcggcgtcatctctacgaggcggagctgaaggaacgccggcgaactcacggacgtcccggccacgaggcccggccccgctgacgccgatcggcacggcggccctgctcgcccgggagcggccgggccgcgcggtgcggcggcggagagactactcctggtagttggcctggcgggggcggcgacgctgcgcgtcgtcggcgatgatgaccgtcgcgaccaccagggccaccacgacggcgaagaaccaggaggcgtcagcgatgagcttcgccgccaggggcgcctggaaggcggccaggaggaagccgacccacgcgaggcggcgctgacgttcagacaggaatccggcagatcgcacccggaaattctggcgcgataagtccggatcgccgtcacccgttcggccgattctgcgttgtccgatggtgccctcagtgttgcgtcggagccgctcaaccattgccgtgatcggtgcgtctgccctggtcggagcgctgtttgcgggattcttccggcgatcaccgcaggtggcgcagccgatactaccagtaaccgagagagtgcaggcgggtccgctgctggatcgcaccggggcctggttgacggtgggggacccggccagccgggtccgggtgcagacggcgaccctgccggggctgctctaccggatcagcgcggcttccgacgccgggatcgtgccggtggtgacccggcgcggtgggcgggtggcggtgcgattccgggctacgcagggtgacggtctggacgaggtgcacatcgtgttgaaccgggatgtccggtgggacatccggctgccggccgggggcggcgagcagcagctgaacctggcggacggccaggtgagccgggtggagctgggcgcgtccgggctggccgaggtgacgctgccggacccggccgggacggtgccggtgacgttcaccggtggggtgggcaccgcggtgctgcgggccggaccggcggcggtgttccggatccgtctggagggcggagccggagcggtggagacaccctgggtggtcaacaacgggacgccgtccggcgcggtcctgcaggaggccgggtggccccgggccgccgaccggtacgcggtccgcgcggtggccgggatgggcagtgtgatcctgcgccggagcgggccggacccgcggccgacaccctgacggcaccgccggggccggccggccccggcgcggacgccgcggtcactgtggtccggtcagtcccgtggtgctcggccgggcgtcccggtcgtcgggttgccgcccgtactcgttgtcgctcgggtcgtcctgcccgtcggtgtcccaggaggccatcgcccgggtcagctcgtccaccggcagtttcttctcgtcgcgccaggcgccttcgacgtgatcggtcatgagcttccacgtacccggtccgggtccggcgaaacgacacgacggtgcggaggaacggccgcgaaacgacacgacggtgcagagaaacggccgggaaacgacacgacggtgcggagaaacggccgcccccttaccgagggggcggccgtgcgaagggagcggatcagatgccgggccggtcgatgtggccccgccagctgccggtggtgatcccgccgcggctctcgatgaactccttgaaccggtgcaggtcgcccttgatccggcggtcgaccagccccagcttgtcgccggcgagctcgaccagcccctgcgggtcgaagtcgagctggaccgtcacccgggtgtgcgtgtcgtccaggcggtggaaggtgaccacaccggcctgcttctcgccgtcggtggcggtccatgccacccgctcgtcgggcagctgctcggtgatcttcgcgtcgaactcccgggtcaccccggcgatggtggtcttccagtgcatgtgcgtgtcgtccagctgctggatctcctcgacgccctccatgaagcgcgggaactcctcgaactgggtccactggtcgtagcaggtgcggaccgggacgttgacgtcaacgaactcggtgaccgtgctcacgcgtctcctccttcactcgcatgccaggcttcagcggtgttctggaacgtctgcccctcgggcagcgttccgatccggcgcagcacgtcgtccggggcggacatggcgcgcgccgaggcctccagcgcggcccggtcacccgggaaggcgttgcggcccaggaagctgccgaaccggctcagggcctcaccctgtgcgctgccgacgccgttcgggacgccgcggccgaaatcgccgttcggggcgatggtgacctccggctggtcctctccggcgggctccggtgtgtgcgactcgtcggcgcgtcccccggccggaccccggaagatgccccggacctccgaggccatctggtcgtccagcaccgcgccgtgcttgctgtttccccgttccatgattgcggggtgccctcggcgaacggggctaaacgtggctaacgtgcggagatggacatggtggatgcgatcgtcgtcggggccggccacaacggattggtggccgcaaatctgctggtggacgccggttggtcggtccggatgctggaggcggccggggagccgggcggtgccgtccgctccggcgagttgaccgcccccgggtacctttcggatctgttcagcgccttctacccgctggggttcgcgtcgccggtgctccgggacctgcacctggagcggtacgggctcgcatggacgcacgccccgaacgttttcagtcacgtgctgccggacgggcgggccgccacgatcagccgggacctcaccgcgacgatggcctcgatggaggcgttcgcgcccggggacggcgagcggtggaaacacgcgtacgacgactgggcggacgtctcggaccgcatgctcccggtgatcctgcggccgttcccgccggtccgggacggtctgcggctggccggccggctcgggtcggtggattccctgcgcctggcccgccgcctgatgctctccgcccgggaactgggctcggagctgttcagcggcgagggtgcccaggtggcgctggccggttgcgcgctgcacaccgacctgtcgccggaggaggcgggtggcggggtctacggctggctgctgtccatgctcggccaggaggtgggctggccggtgccggtgggcggggccggccagctgaccgccgcgctggtccggcggctgaccgagcggggcggcgagatcgtctgcgggacccgggtgagccgggtgctggtggcgcgcggccgggcgatgggggtgcggaccgtggacggccgggactggcgggccgcccgggccgtggtcgccgacgtgccggcgccggcgctgttcctggacctggtcggtgagcggtggctgcccggtcggatggccgaggacctggcgcacttccgctgggacggggccacggtgaaggtggactgggcgctgaccgggaggatcccgtggcgtacggccgaggtggccggctccggcacggtgcacctgggcgccgacctgaacgggctgacccggtactccggcaagatcgccaccggagaggtgccggagcacccgttcctgctgctcgggcagatgaccacggctgatccgtcccggtcaccggcggggacggagagcgcctgggcgtacactcacctgccgcaccgcgaggactggccggccgacgagatcgcggcgcacgtggagcggatggagggggtcatcgaggaacaggcgccgggcttccggaacctgatcgccgggcggcacgtcttcgccccgggcgatctggaggcggcggatccgtcgctggtcgggggcgcgctgggcggcggcacctcggccgcgttccagcagctgttcctccgtccgatccccagcctgggccgcgccgacacgccggtcgaccggctctatctgagcagctcgtcggcgcatccggggggcggcgtgcacggcgctcccggggcgaacgcggcccgcgcggcgttggcccgggaccgggcgctgaccgggggcgcctaccgcgccgtgatcaacgccggtcaccgagcgatctacgggtgagattcggcgatgtcggcgagccggcgcagcgcctcgacgttgcgctggtgcagcaccagatcgttgatcttgttgcgcatccagagcagcggcccggactggaagtcctcgtgcatcaccacccgggtcgcgccgtcggacgccggctccagcacgatgtcgaccaccgcctcgcccagcggccacagcccggcccggatcttgagctcccggccgggcacgcactccagcacggtcgacgagtcgtgcagcgacaacggccacgggccggccttgtggtgcagtttcgagccggtcgccggccagtcctgctcgacgtcgcggatgtgggaggtgcccaccacccagtcgctgtaggaccagccgttggcgagcacggcgaagacgcggtcgggggatgcctgcacggtacgagtcacagtggccacgatgtcgttttaccctgcgtagctgccgcataacgacgtacccgatgtttacgctggaggcagccgggcaacgaaacctgccgttgccccggcgcacgtcgccgctcatgtcgcccagaggagaccccgtgcgaattgcgatgatctccgagcacgccagcccactaggcgtgggcgaccagcacgcccacgtggccgaactctccaccgcgctggccgagctcggccacgaggtgcgcgtctacgtccgtcgcaccgatccggcggtgcccgagatcgtcccggtcggggccggcgtgcacgtcgtccacatcccggccggcccgcccagcccgctgccggacgaacaactgctgccgcacatggcggagttcgccggccggctcaacgagctgtggcagcgcgacggctggacgccggacgtcgcgcacgcccatttctggaccagcggcctggccgcggtcaccgccgcccggcaggccggcatcccggtggtgcagtcgttccacgagctcggcacgattcagccggccggcgccggcccgtcccgcaccggctacgagcgggccctcgggcgggccgtcgaccgggtggtcgcgcagacccaggacgaggtgcagggcctggtccggatcggggtgccacgggcccagctgaccgtcgtcccggccggcgtggacagcgagcggttcaccccggacggcccggtcgccccccgcgacccggaccgcacccgcatcctctcggtcggcaaactcgtcgagcacaaggggttcggcgacgtcatccaggcgatgcgctacgtccccggcgccgaggtggtggtggtcggcggtccgccggccgaccagctcccggccgacccgggcgccaagtcgctgcgcgcgctcgccgaacgcttccaggtcgccgaccggttccggctgatcggcgcggtcccgcaccgggacatgcccagctggtaccgctccgccgacctgctggtcgcggcgccctggcaggagcagttcgaacgctccgcgctggaggcgatggcctgcggcgtgccgatcatcggcaccgcggtcggggggttgaccgagaccgtcgtcgacgggctgaccggcgacctggtcccggcccgcgacccacgggcgctcggcggggccctgcgccggctggtcaacgacaaggtgcgccggttcacctacgcgaccgcggccctcgaccgggcccggcaggcgtacagctggaagcgggtggccgcgcagatcggctcggtctactccgcggtcaccggcctgcgccgcaccaccgccgagccggaagtggtggcctaggcctaatcctccctccaccgaccggtggatggcggagatcgctcaccggtcgattcgggcacccgggtcggtccgtgacgctgagagcatgacagtcatcgaggtcagcaacctcagcaagcgttacggggacacggtcgcggtccgcgacgtgtcgcttgccgtcgaggacggcgagatcttcggcatcctcggcccgaacggggccggcaagaccaccaccgtcgagtgcgtcgccgggcttcgcgagccggacggcgggacgatcaccgtgctcggccgcgcaccgcgggatccggcgctgcggctccaggtcggcgtgcaactccaggagagccggctgcaggacaaattgacggtacgcgaggcgctggaactgtacagcgccttctatcccgagccggcggactggcggacgctggccggtgaactcgggctcgagggcaagctgcgaacgtcgtacagcaaactgtccggagggttgaaacagcgactctcgatcgcgctggccctgatcggcaacccgcggatcgccatcctcgacgagctgaccaccgggctcgacccggccgcccgccgggacacctgggacctgatcgagtcggtccgcgaccgcggcgtcaccgtcgtgctggtcacccacttcatggaggaggccgagcgactctgcgaccggctcgcggtgatcgacaagggcgcggtgatcgccctggacaccccggccggcctggtggcccgcaccgagaccgggcagacgatccggttccgcccgtccgccccgctcgacgacgccctgctcaccgcgctgcccgaggtgcgcggggtgcgccggctcggcgaccgggtcgaggtgaccggcaccggcaacctgctcggcgcggtcagctcgatgctcgccgtccaccagatcgtcgccaacgacctgcgcctggagcaggccagcctcgacgacgccttcgtccgcctgaccggcgtccccacccaggagtgaccatgaacgtcttcgtcaagctcacccgcaccgaactgaaactgcagctgcgcgagccggtcacggccttcttctcgctgctgttcccgaccatcctggtgatcatcctggggagcatcccggcgttccggaaaccgtcgccggagctgcacgggggccggaccatcgacgtctacgtcggcatcgcggtcgcgctcagcgtcgccatgctcggcctgcaggtactgccgatggtgctggccgcctaccgggagagcggcgtgctgcgccggatcgcgaccactccggtccggccgatcaccctgctcgccgcgcagatggcggcgctgatggtgatgtcactcggctccgcggcactgaccatcgcggtcggattcgtcgccttcgacgtgcccctcgcgggcaacttcgccggcttcgtgctcgcctatctgctctgcgcggccggcgtcttcgcgatcgggctgctgatcgccgcactggcgccgaccggcaaggccggcaacgcgatcggcaccctgctgttcttcccgtcgatgttcttcgccgggctgtggacaccgcgcgagttcatgccgggcatcgtgcagaagatcggcgactacaccccgatgggcgccggcgaacgcgccctgcacgacgcgatgaccgggcactggccgaacgggctctcggcggccgtcctgatcggatatctggccgtcttcggcctcggggccgcgcggctgttccgctggaactgacacactggacacggctcaccgggtaggaggacgtcgatgcaggaacagcattcccgccgtcattcgggggtggcgggcgcgttgctcgccggatcgaccgtcctggcggtcatcgcgacctggaccgatctaccccaggagccgcttccgctgaccctcggcgtggtcggcgccaccctggtctggatcctggcgttccgcgctctgccgccgacccggtatcagcgggcgccgtcgatcgccctgttcgtggctctgatcgtgctcagcgccctgctggtctggtgcaacccgctgttcggcttcttcgtctggaccgggtacctgttcaccgcgtacatgctgcccggctggtgggcgctggccggcgcggcggcggtcgcggtggtcaccgcgaccgcccagatcggcggccccgccctggtgcgcggcgccggcgggctgcttctgttcggcacgctgctggtgctcaacgcgggcatctcgatgaccatgacctggaacgagatcggcaaacagcgcaccagcgagcgacggatccggacgatcgacgcgctggcccaggccaacgcgaaactggaggaggcgctcaaggagaacgccggcctgcacgcccagctcctcgtccaggcgcacgaggcgggcgtgctcgacgagcggcagcggatggccggcgagatccacgacgtgctcgcccagggactgaccggcatcgtcacccagctggaggcggccgaggcgcaacccgccgaccgggagaggcacctggccacggcgaaacgactcgcccgggagagcctcaccgaggcccggcgttcggtgcaggcgctgcggccgcagcgcctcgacggggcggccctgcccgacgcgctcggtgaggtcgtcgagacctgggccgggatgcacggcgtacgcgccgatctgatcctgaccggaacggcccggcggctgctccccgagatcgagaccaccctgctgcgcaccgcacaggaggccctggccaacgtggcccggcacgccaatgccggccgggtcgggctgaccctgtcgtacatggaggacatggtgaccctggacgtccgcgacgacggcgacggcttcgacccggcccggccccgggaggtcaccgcggccggcggcttcggcctcgacgcgatgcgcgagcgactcgcccggatcgccggcaccctggaggtcgagtcagaatccggcggcggtacggcgttgtccgcgtgcgtcccggccatcgcgatcggggcggccgcgtgatcggggtgctgatcgtcgacgaccacccggtggtccgtgacgggctgcgcggcatgttcaccgccgacgaccggttcaccgtgctcggcgaggccggggacggccgggaagccctcgccgtcgcggcggcggtccagcccgacgtgatcctgatggatctgcggatgccggtgatggacggggtgaccaccatccggtcgctccaggagagcgggtcggtggcccgggtgctggtgctgaccacctacgacaccgacagcgacgtgctgcccgcgatcaaggcgggggcgaccggatatctgctcaaggacgcgccccgggaggagctgttccgggcggtggtggccgcccaccgaggggagtcggtgctgtccccggccgtggccgggcggctgatggggcgcctgcgggcgccggccggcgagaaggagccgctcagccagcgggagctcgaagtgctgacgctgatcgcccggggatgcagcaaccgggagaccgccgggaggctgttcatcagtgaggcgacggtgaagacccacctgctgcacgcgtacgccaagctgggcgtccgcgaccgcgccgcggccgtcgccaccgccttcgagcgcggcctgctcggccgggattagacctccggtgggcgccaggtgaggaccgggtccatctggcgcaggatcaggtcggggccgaggcggccggccagcgtcatgccggtgttgcgcagccaggcggcgaccgggttggccaggccggccatccgggcgatccggcgggacgcgcgggccaccccggtggtgcggggcagacgctcggcggtgtaccgcgccaggtcgccggggtgggccgcgagcaccgcggcgtcctcgatcgcctggcaggcgccctggcccaggttcgggaccatggcgtgggcggcatcgccgagcagggcgacccggccgcggtgcagggccggcagcggctgatccaggcagcggatgtcggtgcgggtgacggtgtcgccggcggcggcgatcagcgacgggatcggatcgtgccaggcggcgaagtgccggggcagctcgttgccccggccgccgggcgcggcgggggcggtggcgaagcagtagacccggccgtcgccgaggaccaccgtgccgaacaccttgccggcgccccatgtctcggccgggatgatcgagatgccggggtgcgggacgacgaagcgccagctggacacgccggtgtagaccgggcccgggtgatcggggaagagctgaccgcgtacggccgaattgatgccgtcggccgcgaccaccaggtcggccggcagcggcccgccggcggtgaccaccgtgccggtgtccgggtcgaccgccgagacggtctggccgaatcggatcgtgccttccgggagcgccccggcgagcagatcgacgagcgtcgcgcggtgcaccgcgatcaccggatcgccgtatcgttcggtggcctcgtcggcgttgctccgggcgatccaggtgccgtccgggcggcggacaccggccgcgccggcgatgccggagagccggcgcagcggatcgccgagaccgaaagtgtccagggtccgcagggcattgggcgcgaccgcgaggccggcgccgacctgttccaggccggccgcccgctccaggacggtgaccttccagccacgttgccgcaatgccacggcggcggtcaggccgccgacccccgccccgatcaccgtcgcgcgttccatgtccccgatcgtgccacgcctctactgtggtttctgtgatcgacgagtatgcgcaggcccggccggtggcgccgctgcgaccgcacgtcgccttctacaccgggtaccggcagcgcggcgtgccgcccggccggcatcggggcctcccgtcgccctatctgacgctgatcctcaccctcgacgagccgctcgtgatcacctcgcatccggatcgcgggcagccgcccggcgcctatccggcgctgctcggcgggctgcacctgcggccggcgtcgatcacccacgacgggcggcagtccggggtgcaggtggcgctgcacccgctcggctgccgggcgctgctcggcctgcccgccgccgcactcgcccacctcgacatcgatccggcggacctgctcggggcgcggttcgtcgccgaggcccgggaccgtctcggcgcggcgccggattggccggcccgcttcgcggtcctcgatcagatgttgatctctcgtctcgcggaccacgttcccggcgatccgtcgatggcgtacgcgtggagcaccatccgccgcgggccgacctcgatcgccgatctggccggccaggtcgggtggagcgggcggcacctgaccaaccggttccgggccgagctgggcatccggcccaaggaagcggcccggatcgtccggttcgaccgggcccggcgggcgctgcggcccggggtgcggctggccgcgctggccgcggcgcacggctacgcggaccagtcgcacctggtccgggaattccaggcgttcgccgggtgcgcgccgtcgcaatggctggccgacgagttcggtttcgtccaagccgtcgcggccctcgacggccacgatggtgaccatgactgatcacaggagtgctccggcgccgcaggtgtggccgtcgctgcgggccgaggactgtcgggggctgatccggttcctggtcaccgcgttcggcttcgtcgagaacgtgacctacggcgagggcgaccgggtcgaccacgcccagctggactggccgccgggcggcgggatcatgctgggttcggtccgcgacgacgaggtgtcgctgccgccgggcaccttcggggcgtacgtggtgaccgacgagccggacgcgctgttcaagcaggcccgtgccgccggggcgcaggtggtgcgggagccgttcgataccgattacgggtcgcgggacttcgccgtgcgggacccggagggcaacatgtggttcttcggtacctaccgcggcgagccgcggtaggtaccgctcacggcgtcgtcgttcaggcggccagcgcgctggccaggtggtcgcggaagctgcgctcgtcctcggtgaccgtttcgccaccgatgccgagcagaccaccggtggtggccgcgccgaccaccgcgtcggtgatctccagcagccagtggcggtacgtttcggcgtcggccaccgaggccttcgccgcgagcaggctggccgcctcggacgcccggtccagcacgtcctcggcatagccggccgggtcggccggctcgatcaccggcggctcctcgcccagctccgggtcgccggcctcggcgaccgcggcgctggccaccgcggtgaccagggtgctggccgaggcccgggcatccgagatccggcccagaccggccgcgctctcggcccgggtcttgcgggcactgtcaggggtggcggcgctcgccgcggtgagcaccgcatgcgggaggccgaccagcagcccccactcggcgtcggtgaagcccagcttggcgtagagcggttcgtccgtcactcaggaatcctttcgcgttcgtcggcggctcgcgtgtcgtcggcgctgacaggggcattcttgcgcaccgccggtccgccgtcgctccacacaccctctacccgatcatgaccttcttcaccccgtccaccgggtgctgcgacaatccctgggtgcgggaagtggtcgacggaatcttcgagatccgatacgcgggcgtcaacgtccatctggtggtcaccgacgacggcgtgatcctggtcgacaccggctgggccgggcagaccgcggtgatcgagcgggcgctgcgcaagctcggccgtccgctcaccgaggttcgggcgatcctgctcacccaccaccacgccgaccacgccggcggcgccgccgacctgcgtcagcgcaccggtgcccggctggtcgcgcacgccggcgaggccccgctgatcaacggcgcgctccgccccgagctgccggcccgccgcctggcccggctgctggcccgcccgctcgccccggtccccagcaccaaggtcgaccagctggccggcgacggtgccgagccggtccccggtttcaccgtcctgcacaccccggggcacgcccgtggtcacctgtcgttcctgctcgaccgggccggcggcgtgctgttcgccggcgacgccgcggccagccgccgcggccgggtcaccggcccgaacgtgatgttcaccgccgagccgccgcgggccggcgagagcctggcccgcctcgccgaacgcgacttcgagcacgccgtcttcggccacggccgcccgatcgtcggcggcgccgccgcccgcttccgcgaagcggtcgcctgacctaccctcatgcgtcatgatcgatgggcgcatcctgcggcgctccgccgcccggctggtgcgcaccctggccaccatcctgttcgcggtcggcgtggccggctcggtggtgtccgccgtggtcctgctgatcgccctgacggcggcggaccggttcacccgcccggcagccgacgccttcatcaccttcggccggctgctcgccgtcgccgcggtcctctacctggtcggccgcctcctgcgccggcgggaccggagctgacggatcatgcggctgaggccggcaacgaccaccgcggggaatcccgtccggctgaacgagccgccgatgacctgccccggacgtgacatcgggcaaggcgcgtacggcaaaggggtcttccggaaccggtgctcccgggatctcacttcatccgtttctccgcggccgacgcctcgccggtcagcagctgttgctggacgacgacggggacggagagagtcttgtaaccgacggtgtcgaacaggacggtcatcttctcctcctcgtagcccatcaccatgccggtgccccattcgccgtggcggacctggctgtggatcgggaacgggccctcctcctcggcggcgttgaccgcctcggcgctgccgtcggcgcagttgtcgcagtggttgcaggtgcgccggatctcctcgccgaagtaggcgagcagggtctcggtgcggcactgccggctctcggcgaaggcgcgcatcatgtcggtccgcgacttgatcaccgcctgctgccgctcgaactcggcgacggcggcctcggccgccttcgccgggagcggggcgccggccggcacccgcagcttgctgttcttaccggtgcggacggcgccggcctgttccagcagggcgaggtactgcccgaggcggcgcgggccgagcccggtctccttctgcagcgcggtcttggtgatcggtcccttgtgcagcacgccggccagctcgcggagctcgtcggggtcggggccgccgccgttgaagaaccgctggatggcctcgtcctcggcgcgccagaggagcaggacgcggccgggttcgccgtcgcggccggcgcggccgatctcctggaagtagctgtccggtgaatcgggcagggcggtgtgcgccacccagcggatgttcggcttgtcgatgcccatgccgaacgccgaggtggccaccatgatgtcgaccttgtcgtcgatgaagtcctcgtggcgctgctggcgcaggccggcggccatcccgccgtggtagaactcggcggggtagccggcgccggtgagtttctcggcgagttcctcggcggcgcgccgggtggggacgtagatgatgcccggccgctgcccctcgtcgagcagcgcggtcagccgccgccaccggtacgcctcgtcggggcagtgggtgacctcgaggaacaggttgggccggtccagcccggagacgtggatctccgggtcgcgcagtcgcagccgggcgatgatgtcctcgcggaccggcggggaggcggtggcggtcagcgccagcaccggcggccggccgagctgctcgatcatgtcgccgagggccaggaagtcgggccggaagtccgggccccaggccgagatgcagtgcgcctcgtcgatcgcgaccaggcccggtttcagcgatttcacctcggccaggcgttccgggttggccagttgctcgggggtgatgaagaggaactcggcgcggccggcgcggagctcctcgatcgcctcctgctgctcgcgcggtgtctcggcggaactgacccgcacggcgcggaccttcgcgtcggcgcgctcgttgagcgccgcgatctggtcctgttgcagggcgagcagcggggagatcaccacggtcggcccgggcagcagcacggccgggatctggtagatcgccgacttgccggcgccggtgggcagcaccaccagggcgtcgcggcggcgcagcacggcgcgcatcggcttgaactgtccggggcgcagcgacggccacccgaagtgggtgcgagccaccttccgcaggcgggggccgtaaatggggagtttcatcgggcgccctgtgtacccctacttgccgccgaacatgcgccggatcgcccacagcaggaacagcagggcgagcgcgacgccgagcagccggacggcgtgcacctgggaccaatcgacggtggcttccgcgaggggggtgagcggcacgaccgtcactctaccgaggatccggcgacagtaatagaaaggtttgttgactaaacgccgcgcgtggtgtgaccattggtccccgaacgggcgcgagaacgttcacatacacgttgatgcatgtaaacggaggtacgggggctcatgtcgaagcacggcgatctgcccgaacttgccgctgcggtccttcagccgggattcgtcggcacctccgccccggactgggtccgccgatggctcgccggcggcctcggcggcgtcgccctcttcgcccgcaacgtcgagtcaccggcccagatcgccgcgctcaccgcgcaactgcgcgccgagaaccccgacgtgatcgtggccatcgacgaggaggccggcgacgtcacccgcttcgagtcccggctcggcagctcccggcccggcaacctggcgctcggcgcgatcgacgacccgcggctcaccgaggcggtcgcccgcgatctcagctgccacctggccgccgccgggatcaccctcgactacgccccggacgccgacgtcaacagcaaccccggcaacccggtcatcggcgtccgcgcgttcggcgccgaaccactgctggtggcgcggcacacggccgctttcgtccggggactgcagacgtacggcgtcgccgcctgcgccaagcacttccccggccacggtgacaccagcgtcgactcgcaccacgacgtgccgctcatcgagcggaccgccgagcagctcgaagcctgcgagctcgtcccgttccgcgcggcgatcgcggccggcgcccgggtcgtgatgaccgggcacctgctcgtcccggcctacgacaccgacctgccggccaccctgagcccgcggatcctgaccggtctgctgcgcgaggagctcggcttcgacgggctgatcgtgaccgacggcatcgagatgcagggtgtgcgccggcgcttcgggctggcgggtgccacggtccgcgccctggccgccggcgtcgacgcgatctgcgtgggcggcgaccacgccgacgagcagaccgcgatcctgctgcgggacgcgatcgtcgccgcggtgcgctcgggtgagctgcccgaggagcgcctgcgggacgcggtggcccgggtccgggcgctcggcgcgtggacgacgcgtacgcagcaggaagccggcgtggtccgcggaccccaaccggagtcggagatcggctacaccgccgcccggcgggcggtccgggtcacccgcaccgcgcacgcgccggagctcccggtgatcggcgtgccgcacgtggtcgagttcgcgccgccgcgcaacatcgccatcggcgaggagacgccgtgggggatcggggcgccgctgaccgacctgctgcccggcaccacctcgatccggctcggcgccgaggacctgaacggcctctgcgatccggcgagccgggtgctggacggcgcggccggccggccgctggtgctggtcgtccgggacgtgcaccggcaccggtggatcgaggacacgctggccggggtgctggccgtgcggccggacgcgatcgtggtggagatgggcatcccggtgaccgtggtcggcggggtgcacgtcgcgaccttcggggcgacccgggcctgtgggctggccgcggccgagctgatcgccggcgcggtggtgccggagccgatcgcggcctgaccgtgcgggtcagtgggcgaccagctccgcgtcctccgggtgcccactgaggtagtgggcgaagaacgggcaggccggcacgatccgccagccccgctcgcggatctcggcgagcgtccggcgggccagctcgcccgccagcccgcgcccccgcatgtccggatgcgtctcggtgtgcagcaccaccaccacgtcctcgccgcgcatccggtagctcgccagcgcgcccaccgcgccgtcgaccgccagctcgaaccggtgcgccacggtgttgtcccggaacgggtggtcgctcatggagggcctcctcaggagatcggggtgggcaggatagcgcgtggagtttgacggggagcgcgttcggtcacattgagggacatgtcctccgccacctcgaacgtcaaataccacgcgtcccgcgcggcgaacagcaagcctctggagtatctggcccggggcggcttcgtcggttacggcatcatccacctgctcttcgcctggatcgcgctgcaggtcgcgttcgacggttcgggcaaggagagcgaccagtccggcgcgctgtccgagctcgccgccaagccgttcggcaaggccctgctggtgatcatcgcgatcgggttgttcgcgatggcgctctggcagctgttcgccgcgatcgacgggcagagcggcgagcagaaccggagtgcggtcgccgaacgggtgacgtccggcatccgggcggtcctctacgtctacctcggctgggtggcgatcaaggtggtccggggcgcgaacgcctcgatgggcgacaattcggagagccggtcggccgggctgatgcagcactccggcggccgctggctggtcgggctggccggtctggtggtgctcggcgtcgggatcgggatcttcgtgtacggcctgcggaagaagttcaccaagcggctcgacacggcgaagatgccagcttcggcccggcagaccgtcatccggctcgggatggccggttacagcgccaaggggctggcgtacgcgatcgccggcgtcctgttcctcaccgccgccgtcacctacgacccggacaaggcccgtggcctggacgccgcgctcaagacgctggccgggcacccgtggggggtctggctgctggcactgatcgcgctcggcatcgcggccttcggggtgttctgcttcgctcaggccaaataccgcaaaatctgactgtgagctggatccgacatccgtcatagcgggtgtccggccgcccgggaccgggcaagttggggcgctggcacagcactcgaccatggagaggactgttcgtgtccagcgttctgactgccgtgctcggcatcaccggggccgccgtcgcggccatcgtgatcgtcgaagcgtcccaccgggtgatgctgcgcatcggtcgccgttcgcccctggccgccgacctggcccgcaccatgcaccggccgttcctggccacgctgaccctgatcgcggtgcaacaggcggtccgggtgttcggcggcgacttcccgggccgggccgccgtggtgcacgcgctcgtcatcgtctgtatcgccgcgttcgcctggctggtggccgcgctgctgctggtgctggaggacatgacgctggcccggtggcgcaccgacgtcccggacaacctgcgccgacgccggatcaagacccaggtggtgatgctgcgccgggtgaccgtcgcctcgatcgtggtgctcaccgccggcgtgatgctgatgaccttccccgggatccgggcgctgggcgccagcgtgctcgcctcggccgggctggtcagcgtgatcgcggcgctggccgcgcagagcacgctcggcaacgtgttcgccggcatccagctcgccttcagcgacgcgatccgggtcgacgacgtggtcgtcgtcgagtcggagtggggccggatcgaggagatcaccctgacctacatcgcggtgcagatctgggacgaccggcggctgatcctgcccacctcgtacttcaccaccaagccgttccagaactggacccgcagcagttccgcggtgctcggcaccgcggagatcgacgtggactggtcgacgccggtcgagccgctgcgggccgagttgcgccgggtctgcgagggcaccgaactgtgggaccggcgggtctgcgtgttgcaggtgaccgaggcgaccggcggtacgatccggctgcgcgcgctcgtcagcgcggccgacgcgggcgctctgtgggatctgcgctgcctggtgcgggagcgcctggtcggctggatgtgggagcaccagcgcggcgcgctgccgcggacgcgcacccagctcgacgaggtggacgacggggcggcaccgatacggcagtctcggagggcggcggaggcctcgccggacgcccgggtgttcagtggtggcaacgacggcgaggcgcggggtgtggcgttcggagcggcggaaaacgacccggcgccggccgcgcggtgaaggattgagtaacgagtgatcagggcatacaccggacacagcgaaaagggggggacacgatggccgatgtgctcaacggcagagcccgaccgttgtccgaacagtccaccgcggagttggtgcaacgggccagcgagcagctcagccggctggtcaaggatgagctgacgctggccaaggccgagctcgccgagaagggcagacacgccgggatcggcgtcggtctcttcagtggcgccggtgtcttcgcgatgtacggtgtcggtgccctgatcgcgaccgcgatcatcgcgctggacctggtctggccgctctggctggcgagcctggtggtcaccgtggcgatcttcctggtcgccggtgtgctggcgctgatcggccggtcgcagttccgtcgcgtggcgccggccgagccggtggccgcgatcgagggtctgaaggctgatgtcgacgaggtcaggcacgcggtcaaggagcgaggccggggatgagcgagagcagcaacggtacgacaggcaagcccgacctggtggcgctgcgggccgagatcaagcagacccgggccgagctgggcgagacggtgcaggcgctggccgcccgggcggatgtcaaggcgcgggcccgggagcaggtggcgcagacccggcagcggctgctcggccaggccgcggcggccggtgatcggctgcaggcggtctcggccgggacggtgcgcgccaaccagttgccggtggtgctgatcgcggccgggctggccgcggtcgtcggagtgatcctgatcgtgcgggggaggcgctgatggcggggaaactgggcaagatcgccctcaagccggtgaacgtggtggcggggatcgccgccggcgcggtcgccgggctgcttttcaagcaggtgtggaagctcgcctcgggcgacgacgacgccccggacgccggcgacgaggatcgtggctggggtgaggtgctggccgccgccgcgctgcagggtgcgatcttcgcggtggtgaaggcggccgtccatcgtggtggcgcggtcggcgcgaagcgtctgaccgggcagtggccggactagaccggtgcccgttgtctagatcaacaccggtatagacaggggtcttgacggctccccacttcgtaaccgcgaagtggggagccttttccatatctgccacgctttattggattccttcgaggggcagctttgcggcctgtttttcgggtacagtgtggccagtttttgcgtacgtggttcgctgcttccgccaagcggagcgacaccggccccgtcccggcgggtcaccaggtgccgcaaagctgaacggaggggacgtcctctgaaagggccgcctcgcggcgccgctgctcgaaaacggtcatcggccccgcgctccgctgccgcgtagggcgggccggcattttcagaaggagagttcagcatggcgcaaggaaccgtgaagtggttcaacgcagacaagggcttcggcttcatcaccgtcgacggcgggggtgctgacgtgttcgtccacttctcggccatccagacgagcggttaccgcactctggaggagaaccagcgggtggagttcgagatcgcccagggccagaagggcccgcaggcggagcaggttcgcccgctctgagaccaatccgccggccgcgaggccggcatgccggccgcctggcggaggccggcctgaccggtggccccgcatcctcatcgaggttgcggggcctcttttgtacgccctattgttccgccatttgtcggacggttcaggaaagcgatccgccggtccgtcggcgcatgccgattaccacgagagccaggccgagcacgatcaccacaccaccggccgcggcccacgccggctggtcgctcatcagttcgttctcgaagacgtcgagaccctgcagggtccacacggtgccgagcacgatgccgagcaggcccagggacatgctcagccagccgcgcaaccgggtggggtcgccggcggtggactcggtttcattgttcaccatttgtcgtgcacctgggggcgaatcaactcatcgtagaccgcgttgatcatttcccgggtttccggcgaaagcgacgggaggtccccggcgtgcgcgttggcgcgcgcctgctcgggattacgcgcacccgggatcaccacggtgacggccggctgatcgatgatccagcgcagcgcgaattgcgccatcgtgacgccctccggaacgagcgggcggagtcggcggaccgcctccaggccggtcgcatagtccactccggagaacgtctcgccgacgtcgaaggactcgccgtgccggttgtagttgcggtggtcgtccgcggcgaacgtggtgtgctcgtcgtagcgcccggagagcagaccgctggccagcggcacccgggcgatgatgccgacaccggcctcggcggcggccggcagcacccgctcgagcggcttgagccggaacgcgttgaggatgatctggacgctggcggtgcccggccgggcgatcgcggcgagcgcctcctcgaccttctcgacgctcaccccgtacgccgcgatccgcttctcctgcaccagcgtgtcgagtgcgtcgaagacctcgtcgctgttgaacaccggggtcggcgggcagtgcagctggaccaggtcgagcgtgtcgacgccgaggttggcgcgggaacggtcggtccaggcccggaagttgtcgatcgagtagttcgccgggacctgggggagccggcggcccatcttggtggcgacggtgagaccgggtcggtccttcacgaacgagccgacgatctgctcgctgcgaccgtcgccgtagacgtcggcggtgtcgatgaaggtgaccccggcgtcgaccgcggcctgcagggtcgcgtgcgcgtcggcctcactgacgtcgccccagtcggcgccgagctgccaggcgcccaggccgatcaccgaggcgtcgcggcccattcggcgaaagcttcgtttttccacgggaagaccctaccgccaagctgctatcttcaaacaagacgtacgtacggttttgatcaggaggcgtcatgtgggatccggccgtgtaccagcgctacggcaccgaacggtcccggccgttcttcgacctgaccacccggatcggggcgcggcgaccgcgcgaggtcgtcgacctcggctgcggcttcggcgacctcacccgcaccctggccgagcgctggccggccgcccggatcaccgggatcgactcgtcccccgagatgatcgccgcggcgaccggcggcgacttccgggtcggcgacatcgcggactggacgcccgggccggacaccgacgtcgtggtcaccaacgcggcgctccagtgggtccccggccaccagcggatgctcacccgctgggtgcgcgaactgcccgccggcgcctggctggcgatgcaggtgccgggcaacttcggcgcgccgtcgcaccggctgctgcgcgaggtcgccgccgggcacggcgtcgagcgcggcatccgggagtcgccggtcgacgagccgaccgtgtacgccgagagcctgaccgccgcgggcgccgcggtggacgcctgggagaccacgtacgtgcacctgctgccggtcgacggccccgaccacccggtgctgcgctggatggagggcaccgccctgcgcccggtgcgggccgcgctgaccgccgacgcgtggacgtcgttccgggccgagctgggcgcccgcctcgccgaggcctatccgaccggacacgcgcacgtggcgttccccttccgccgtatcttcgtggtggcgtcaatctagggagataccgtgtccgacctgaccgagttcatcaccggcctgcccaaggccgaactgcacgtgcaccacgtgggttcggccagcccgcggatcgtcgccgagctcgccgcccgccacgagggcagttcgccggtgccggccgacccggccgcgctcgccgactacttcgagttccgcgacttcgcgcacttcatcgagatctacctgagcgtggtcgacctgatccgggacgccgccgacgtgcggctgctcacctacgagatcggccgggagctgagccgccagcgggtgcggtacgcggagctcaccgtgacgccgtactccagcgtgcgccgcggcatcccggcgccggccttctgcgaggcgatcgaggacgcccgggccggcgcccgccgcgacttcggggtcgagctggcctggtgcttcgacatcccgggcgaggccgggctgccggcggccgaggagacgctgcggatcgcgctggaggagaggccggacggtctgatcagtttcggtctgggtggcccggagatcggggtgccgcggccgcagttcaagccgtacttcgacaaggcgcgggccgccgggctgcacagcgtgccgcacgccggcgagaccaccgggccggagacgatctgggacgcgatccgcgacctgggtgccgaacgcatcggccacggcatcgccgccgctcaggacgagcggctgatggcccacctcgccgagcacgggatccccctggaggtgtgccccacctccaacctgcgcacccgcgcggtcgccgacctggcccggcacccgatcaccacactggccgcggccggcgtcccgttcagcgtcaactccgacgacccgccgatgttcggcacctccctggagcgggagtacgcggtcgccgccgagctgctcgccctcgaccacgccggggtggccgacctggcccgcgccgccgtccgccacagcttcctgtccccgcagggcagggccaccctgctggccgagatcgacggctacgccgcgggcttcccggagtaacggccacgcacggcccacgggcctccccccggtgggtttcgcgttccggtcgcgccagcggcctgcgaagcccgccggggtctcgtcggcggcagcgatcagttgccggccgcagcgcacgacctccgccggaatgaccgtgatcccggctcgccggagggcgggtcagggatagagcggatcctgccagagggcgagcatcaccaccgtgccgatggtgaggatggtgagccagcggatcaggcgccggcggttgaagcgcggctcctcctcctcggtgtccgggtggttcagcacgtcacgcatcgtcgtctccttcgaaaagtcagctcggcaccgcggtccagctctggtggcgctgcccggtgtccggctccagggccagcacccggtgccagccgaagcgctggccgccgacgccgacggccaggtcgccggtttcgctgcgcagcgtgaagccgaagtcggaggcctgcagacgccagcgggcgccggcgttggcgcagtcgccctggaccagcggggcgccggcgaccggggtgccgccgagcggcatcaggcatttgccgctggcccgggagatcagcgtgtagctgccgctgtccgcggccgggctgagctgccactgctgctggttgccgccgtcggccgggccgagagtggccggcgtgccgtcggcggcgcgggccgcgtagaggtcggcggcgccgccggtcagcgagttggtcaggacgaaccaggaattctgcaccgggcgggcggcgggggcggtgtgcgcactgccggtcgcgtggtacctgttcgtccggctgcggacctcgaccttgtacgccgagtccggcttgaggccgatcagcagcgcccgggtcgccttggtggtggccaccggcttgccaccgaccgacacctcgtaggtcgcggtgtccgacgcggcgctccaggtcagccgcaccgacatgctggtcgcgtcgcggatctccagggccgcctggacgtcgccggaaccggccggggtcccgtcgggcgcgcccgcgtcctggtcgccggaggagttcccggcgtggtaggcggccggttcggcgtcgatgccgtccgggccggcgctggcccggggcagcggggcggccgacgcgctcggctagctagctagggcggccggcggcgcggcggcctggcccgggtcgggggtgaccgcgccgggtacgtccgggatgtcgttgccgccgtcgctgcgcagcaggaagtcgctgagcgcgacgttccagtgggtgtccaggtagctgcccggcttcgggttggtgttgaagtagtcgtcgtggccgcagtccaggcgcacctcgtgcgccttcgggcaggacgaccgcaccgcccggccggaccggtcggggccgcacagcaggtcgtagtcgtccaggcagccgcccgcgccggtgccgttcggcgcgccgttgagcaccgcgccgaacgcgtgggtcagctcgtgcgcggccatcaccgaactccaacagccggagtcgacccgggcgtaggacgggccggcgttgttgttgttggtccggcccggccggttgtcgtcgacgtaggtgccgatcccgcagtagacgttcgcgtcggagaacatcaggtacttgcggtcggtccggttgtagccgaggttgccgagcgccttgacggtcgcggtgaacgagtccagcgacccggccggcagctccacctcggagaccgcgaccgtgcactccggcgtggtcacataccgcacgtgccgggagccgccggtctcgccggcgctcgcgtcgaagatcgcgtcgacgccggccgcccaggtgcggaacgagttgacgtaccggttgtaccgggtggcggtgcccgcggcgtacacgtagagcagctgcacccgcttgccgtcctggccgtcgccgtcgcaggccacgccggccgggccgagcacgaagtcggcgttgcccggggccgggtccgggatcagcgccggcgcgtccggggtgagcgcgctgccgcccaggtcgcgggcgatctcggcgtcggtcgggacgaccaccgggtgcatggtgcgcaccgtgccgggcagcctggtcgcggcggtgaccggggcgacgtcctcgcgcaccgacaggccggtgggcgcccggtccgggccgtgcgtgcaggtgtcgtcggccagcaggtacgacccggcgcacagcgcgccggccgcgaccggcttcagaccctcgtagaccaggccctggtcgggggcgtccttggggagcgcggtcagctggaagcggcccgggtccttacgcgacgaggcgccgatcacgctgggaccgacgacgccgccgaccccgagcagggtcagcccgagcgccaccgggaggagtcgagaggttgcggagcgtgacggccggcggcggctgccgggtgagccagggaaggctgaccggcggtgcgcgggcaaggcatctcctcgacgtgcgggtgggcggtgggaggggaccatggggtgtccgccccccaccgctccggggctccgccggccgcggcgatggggatgtgctgcggtgagcgaaccggggagccggatgggatcggagggaacactgccagcccgggcgagccaggggaacactcttaaaacagatctaagcaacttctggtccgtctgggggaatcaggtggcccgctggccgcggcggccgcgaccaccgcggccgaccaggccgaaacggctgggggttttcggggtggcgtcggcgtcggcgatcagcatcaccacgctggcgccgcccagcgtggcccggtccaggctgaccgagccgccggtcgactgggtcatccggcgggcgatgtccaggccgaggccggtggagccctgctggctctgcccgcgacgcagtgccttctccgggtcggggatgcccgggccggcgtcgtcgacgcgcagcgccacccagccgtcccggcgggagagcgccacctcgaaggcggtgccctgcggggtgtagcggaacacgttgccgagcaccgcgtccagggcggcggccaggtcggcgcgggggaccggcaccgggatccgcacgtgtgcgccggtcacccggtactgccgctcctggtcgccggcgagcgccgaccagaacgacatccgttcccggaccacctcgctggcgtcacacaggccctcctcggggttggccgccacctgtgcggcgaccgtctggcgggtagtgttgatcagggagttgacctcgtcctccagggtggcgatggcctgccggatgcgccggatgccgcgccgccggtcgacctcgtcggcggtcaggtcgatgatctgcgtgtcgtccgggtcgagtgcctcggcgtccagccgcagcgcggtcagcggggtgcgcaaccggtgcgacaggtcggcgaccagctcccgctcgtcggtgcgggaggtgaccaggcggtcggccatccggttgaacgcgtagccggcctcggccagctcgcgcggcccggacgggtggatccgcacgccgaggtcgccgtcgccgaccgcgagggccgcctcgaccaggttgttggccgagttgaccgcgccccgggcgagccggtcgaccacgatcaccgagccgccgaccagcaccaccgccaggccgagcaggagccaccagtcccgcgcggtgttctcggtcagctcggaggccggcacgaacccctcgaccacccaggccttgccgccggcggtcaccggctgcagccggatcaccccgcccggcacctcgatcacgctggcgtccggccggctggcggcctcgtcgatctgcttgccggtggcccggccgcccggggtgggcgccaggccgggcacgtgcacgaccggatcgccggccgtcgccgcggcggcggccacgcccttgtcgcccgcgccggccagcagcgcgccggccaccgtggaggtggcccgggcggcgccggcgagtgcctcctcgcggtggtcggagcgcaggccccagcccagcgggacgaggaagaccagggcggcgacggcggtggtggcggcggtcgtgtacgccagccgcagcctcagtccggcgccaccaaccggaatccgaccccccgcacggtgcgcaggtaacggggcttcgccgcggactcgcccagtttccggcgtagccagtacaaatgcacgtcgatggtctggtcctcgccgaccgagggctgccgccatacctcctccaacagctcacgacgcgagaccactcggcccgggcgggcggcgagataggccagcaggtcgaactccttgcgggtcaacgccagcggctggtcgccgagggtggcgctgcgctcgcccacgtcgacccgtaattctcccacctcgtggacggcgggctgggcggcccggctggcccggccgacccggcgcagcaccgtgccgatccgcgcgtccaggtgggcgccggtgaacggtttcaccatgtagtcgtcggcgccggcgcgcagcagccgcaccacggtctgctcgtcgtcgcgcgcggtggcgatgatgatcggcacgtcggtgatcccgcgcagcatccgcagcgcgtccgacccgtccaggtcgggcagcccgaggtcgagcaccaccaggtcgggggtctccgcggcgacccgccggagggcctccagcgcggtgccgacggcgtgcacggcgtgcccacggtcggcgagcgaacggagcatggcaccacgcacgacatgatcgtcttcgacgagcaacaccgtggccatgcgaagaccgtactgtctccggcgggggaaacctaaaggctcatggaacgagatgctttgatgaccctcagtgatggaatacgatccgaaccaccgatgacgttcaccctcttccccgatacgcgccgcgcgctggccctggacagcctggccggcctgagcgtcggcgacgccctcggcgcgcagtatttcgtgcccggcaaccggcccgccgacctgctcgacgcccgggtgcccgcgggcgtctgggcctggaccgacgacaccgagcaggcctgctgcctggtggccgtcctcgaggagggcgacttcgaccgggacgccttcgccctcctgctcggcgagcactgcgaaccctatcgggggtacggcccgggagccgtggtgatgctccggcagatccgcgaagggctgccctggccgatcgccgccgcggccgccttccacgggcaggggtcgtgcggcaacggcgcggcgatgcgggccgccccgctcggcgcctggcacgccgactccctcgcgcacgccgccgcgcagggcgctagctagctagcccggatgagatcgggtcgggtctggtggtcttccacccgaagggtggggtgatcaagcgggagatggaggactacgtccgggcccggcacatcgaggagggcttccagtatgtggggaccccgcacatcaccaaggagaacgtcttcgtgacctcggggcatctgccctactacaaggacacgatgttccccccgatgcagttggagggggcggactactacctcaaggcgatgaactgcccgatgcacaacctgatcttcaggtcgcgcgggcggtcgtatcgtgagctgccgatgcggctgttcgagttcggcaccgtgtatcgctacgagaagtccggcgtggtgcacggcctgacccgggtgcgtggcctgacccaggacgactcgcactcctacgtgaccgccgagcaggcgcccggcgagatcaagcacctgctgaacttcgtccgctcgctgctcgacgacttcggcctggacgactactacctggagctgtccacccgggacccgggcagcgacaagttcatcggcaccgacgagcagtgggagaacgccaccggcgtcctggagcaggtggccagggagtccgggctggacctggtgctcgacccgggtggggcggccttctacggtccgaagatcagcgtgcaggccaaggacgcgatcgggcggacctggcagatgtcgaccattcagtacgacttcaacatgccggcccggttcggcctggagtaccaggcggcggacggctcgcgtcaggagccggtgatgatccactcggcgaagttcggctcgatcgagcggttcttcggcgtgctcaccgagcactacgcgggtgcgttcccggcctggctggcgccggtgcaggtggtcggcatcccgatccgcgacgaccacgccgactacctgtcgtcgttcgtggagcgcctgcgccgggagggcatccgggccgaggtcgactactcgtcggaccggatgcagaagaagatccgcaccgcccagcagcagaagatcccgttcatggcgatcgccggcgacgacgatgtgaacggcggcaccgtgtcgttccgctaccgggacggctcgcagcgcaacggcgtgacgctcgacgaggccgtggcgcacgtggtggagatcgttcgctcccggatcaataccgggccctcggccgcctgatctccggccgggccggcaccggacgacggggagggtcacgtcgccgcgccgcgccgcgccgcccgggcggcgcggcggcgaccggttccaccggcacgaggagctcgcaccggccgcggcataggatgcggtggtggtgatggatgtgaccggcgagccggacggcctggagcgactctggacgccacaccggatggcctacatcaccggggagaacgcgcccgcgggctgcccgttctgcgtcgcacccggcctgccggagggggacagcctggtggtcgcgcgcggcgagctggtcttcgcggtgctcaacctgtatccgtacaatccgggccacctgatgatctgcccctatcggcacgtcgccgactacaccgacctgaccgaggaggagacggccgaggtcgcggcgtacacccggacggcgatgcgggtgatccgcgcggtgagccggccgcacggcttcaacctggggatgaaccagggcgcggtggccggtgccgggatcgccgcgcacctgcaccagcacgtggtgccgcggtggggtggcgacgcgaacttcatgccggtgatcgggcggacgaaggtgctgccgcaggtgctcaccgacacccgggtcatgctggcgcgagcgtggccagcatcctgacgccggccaccacctcctcggccgacggagcgctggccgggtcggtcagccactgggtgaccacgccggacatcagcgccatctgcaccgcgccgagcgagcgcacggtcgcctcgtccagctgatcctcggcgatgccggtgagcatcgccgccatcccggtgcggccggccgtgagcccgcccgcgagctgctccttgagctgcgggttgtgctcggcctgcagggccacctcgatgctggccagccagagcggccggtcggtctggatcgacccgatcacccggcgccagaagtcgagcagcgggtcggcggtcgggtcgggggcggccagcgcccggccgagcgcgttgccccagtcctccatggcgctgagcatcgccgcggtcatcagcgcctcggtcgagccgtagtgatagccgatcgaggccaggttggtgcgcgacaacgccacgatgtcccgggccgtggtgcgggcatagcccttctccagcagcgccttcttggcgcccttcagcagctcttcacgatggcccatgttttcagatcctaacctctatacattcgtataagacacttgtatggtaagtggcatgacgaactcacgggtactgatctccggcgccggcatcggtggtccggctctggccttctggctgttccagcggggcttcgaggtcactgtcgtcgagcgcgcgtccaccgtccgcgagggcggctacaaggtcgacgtgcggggctcggccaccgccgtgctgcgcaagatgggcctgctcgacgcggccaaggcggccgacaccggcatgcagcagatcacctacgtcaagccggacggcagcccgatcgccaagctcccggccgacctgctgatgggccgccgcggcgacgacctggagatcatgcggtgggacctcagcaagatcctctacgaggccaccgaggatcgggtggagtacgtgttcggtgatgcgatcgcctccctcgccgacgggccggacggggtcgacgtcaccttcgagcacggcgcgccccgccggttcgactacgtggtgggcgccgacgggctgcactcggccacccgccggctggtgctgggcgagaccccgctgaccttcctgggcgcctacatctcgatcttctcggtccccaacgacctgggcgtcacccgcgaggaggtgttctactcgcgacctggtcggctgatcttcgcctacgcgatggagcccggccagccggcccgcgtcggtatggtcttcgcctcccccgagcggcgctacgaccaccgtgacccggccgcgcagaaggcgatggtccgcgaggcgttcgccgggcagggttggcgctccgacgagttcctggccgccatggagaccgcgcccgacttctacttcgactcgatgagtcaggtcgagctcccgtcctggtcgtccggccgggtggtgctgctcggtgacgccgcgcactgcccgtccccggcctccggccagggcacctcgctcgccctggtcggggcgtacgtgctgggccggcacctgggcgagccggagggcctcgcggcgtacgagcgggagatgcgcacctacgtggagaagaatctggccttcggccgcaagatggtcaaggacatggtccccggtggccgcctcaccatcgccttccggcactacgggatgcgcaccctgaaataccacccgcagaaggagaaggtgatcaacaaggtgctggccccgatgcacgaggcggccaacgcgatcactatctgacggcgtgctccttcttcaccgcctcgacgaggtgggccggcatcggctcgtgccggacgtacgaccgggagaacgtgccggctcccgaggagagggcacgcaactccaccgcgtaccggaccagctccagtgccggcacctcggcccggaccaggctgtgcccgccgtcctcggcggtgtcggtgcccagcgggcggccgcgtcggccggacaggtcactcatcaccgcgccgacgtaggtgtccggcacccggaccaccacctcgtccaccggctccagcagggtcacctgcccggccgcggccgcctcgcgcagggccagcgccccggcggtctggaaggcggcgtccgaggagtccacgctgtgcgccttgccgtcgaccagggtcaccttcaggtcgacgaccgggtaaccggcgatgatgcccttctccagctgggcgcggacgcccttctccaccgacgggatgtagttgtgcggcaccgcgccgccgaccacccggtcgacgaactggaaaccggagccgcgcggcagcggttcgatctcgatgtcgcagatcgcgtactgcccgtggccgccggactgcttgacgtgccgcccgtgtcccttggacgcggcgccgaaggtctcccgcagcgacaccttcaccggctcggtgtccagctcgacgccgcccgcccggagccgatcgagcaccacgtcggcgtgcgactcgcccatcgtccagagcaccagctggtgggtgtccggattgcgctccaggcgcagcgtcgggtcgccggcgaccaggcgggcgaggttcttggcgagggcgtcctcgtccgagcgggtcttggcgacgaccgcgatcggcagcagcggctccggcatcgaccagggcgacatcaggatcgggtcgtccctaccggagagcgtgtccccggtctccgccgacccggacttggtgatcgcgcagatgtccccggccacgcaccgacccacctcgcgcagcgtggcgccgagcggggtgtagacgtgcgccacccgttcgtcggcgtcgtggtcggggtggccgcgctcggccatgccgtgcccggacacgtgcagcgtctggtccggtcgcagggtgccggagaagacccggaccagggacacccggccgacgtgccggtcgatcgtggtgcgcaccacctcggccaccagcgggccgtccgggtcgcagaccagcggcgggcggggcgcgccgtccaccccggtgaccaccggcaggtcgtgctccagcggtgacggggcggcgctgaccaggccgtcgagcagcgcgtccaggcccaccccggtggccgcgcagaccggcacgaccggatagaagttgccccgggcgaccgccttctccaggtccgggatcagcgcgtcggtggagatcagctcaccggcgatgtaccggtccatcagggtctcgtcctcgctctccgcgatgatcccctcgatgagctggttgcggtcgtcggcgatcgggttgaggtgggcctgctcggcctcgccgacccgcggcgggtaaccggccgagtagtccagcacccgcagcgacaccaggccgatcaggccggccaccgaccggccgtcgtcgcccagcatcggctggtagatcggcatcacgttctcgccgaacgcctcctggcagtcctgcagcgcctgctcgtagtcggcgcgcggatggtccaggcgggtgatcgcgacggcccgcggcatgccgaccgcggcgcactcctcccagagcgcgaccgtcgactcgtccaccccgtcgaccgcggagaccacgaacagtgccgcgtccgccgcgcgcaggccggcgcgcaactcgccgacgaaatccgcgtaccccggggtgtccaggaggttgaccttgacgtcctgatggacgagtggcgcgcaggacagcgccaccgagcgttgctgccggaccgccgccggatcgtgatcggtgaccgtggtgccgtccgcgacggtccccgcgcgcgggatcgtgccggtggccgccagcagcgcctccaccagcgtcgtcttcccggcgccggagtgacccaccagcaccacgttacgaactctgccgggctcggtcaccaccggcgcggcggcgccggcgagccccttctccgatgtcttctgcgccatgccgagcgctccctgtcgtttccgcgtcgtttcgccgctgttctacaaatcccacacccgggcaggtcccggtcgcaaggaccggaagccaccagaggatgccggatggtgacgatccggccaaccggggggggcgagccgtaccgcgaccgggcccacgccgatatggtgggacggccatggcaaagatcgtccaagtaacggcccgtgccgtcgtctcgtacggcgtcaacccggtcgcacgttccctgctcaagatcggcgtctcacccgacgccgtcaccgtcgcgggcactgtcggggtgctgatcggttcgtacttcggtgcgcgcggtcacctcttctggggcacctggatcgtaaccgcctgcgccctcaccgatgtgctcgacggcacaatggcccggcttcggggcagttccggcagattcggcgcgcttctcgactcgtcgatggaccggatcgccgacggcgccgtgttcggcgccgtcgtctactacctggccacccagggcaatccgtacggcggtgtccccgccgcgctgatctgcctggccgccggtcaggtggtgtcgtacgtgaaggcccgcgcccagtcgctgggcctggacgccgacgtcggcgtcgccgagcgcctcgagcgtctgatcatcgtcggcatcggcggcctgctgggcagcgccgggctggcctggggcctgcccgccgcgctctgggtgctggccgcgctctcgctgttcaccgtcttccagcggctgctgcacgcccggcgcaccgagcccaaggtcgcggccgagtgaaggaccggctgaccacgctcggctacctggccggctggcggctggtgcgggcgctgccgctcccggtcgcccgggcgctgttcaccacggtcgccgaccgcgcctggaaagccaacggcaagggcacccagcggctgcgccgcaactaccggcaggtggccggcccggacatgccggagaccctggtccgggacgggctgcggtcctatgcccggtactggatggaggcgttccggctgccgtcacagacccgggagcagcacgtggccggcttccacatggaggccgccagctatgacgagatgaagagcgtcatcgccgagggcaacggcatcgtgctggccctgccgcacatcgccaactgggacgcggccgcggcctgggtggtgtcgcacggctggcagatgatcaccgtgcaggagcggctcaagccggaggcgctgttccaggcgttcatggactaccgggagagcctcggcatgcgggtgctggcgctgaccggcggtgagcgggcgccgctcgacgtgctcgccgagcacctgcggcagggctgggtggtcccgctgctggccgaccgggacatgtcccgcaacggcgtcgaggtggagttcttcggcgggcggacccggatgccggccggcccggcgatcctcgcggtgcggtccggcgccccgatgtatgccgtcgacatgtggtactccgagcatcgcgtcgaggcccggctgcgcaagatcaccccgccggtggacgggccactcgacgagcgggtgaaacgcaccacccagctgatggccgacgccttcgcggccggcatcgccgaacacccgcaggactggcacatgctccagaaactctggctctaggaggtcggggttgcggatcgggatcgtctcgccctactcgttcgacgtgcccggcggcgtgcagaaccacatcatggacctcgccgaggcactgatcggtctcggacaccacgtgagcgtgctggccccggccgacgaggacgccgagctgccgcactacctggtaccggccgggcgggcgctgccgctgccgtacaacgggtcggtggcccggatcgccttcggcccggtctccaccgcccgggtgcgccgctggctggcccgtggcgagttcgacgtgctgcacgtgcacgagccgctgacccccagcctgtcgctgctcgcggtgctctccgcgcgcggcccggtggtggccaccttccacaccgcgatgacccgctcccgggcgctcgccgtcgcgcagaacttcctgcagccggtgctggagaagatcaccgcacggatcgcggtcagcgaactcgcccgcaaggtgcaggtcgaacacctcggcggcggcgcggtcgagatccccaacggcgtcgcggtggcgaaattcgccaccgccgccgccctgcccggatggcccggcgagggcgggaccctcggtttcctcggccgtttcaccgagcctcgcaagggcttccccctgctgcgtacggcgtttgtcacgctcgcccgggagcgtcccggcctgcgcctgctggtggccggcccgggcgaccgcgacgagctgttcgaccggatcccggccgagctgcacccccgggtcgagttcctcggcctggtcagcgaggcggacaaggcccggatgctgcgcagcgtcgacatctacgtggcgccgaacaccggcggcgagagcttcggcatgatcctcaccgaggcgatggcggccggcgccacgatcgccgccagcgacctcgacgcgtttcgtcgggtattggacggtggccgggccggcgcgctgttccccaacggtgacgccgccgcgctcaccgcgctgctcagcgcgctgctcgatgatccggtgcggcgcgctgacctggcaagctgcgcccgccaggtggtcggtacgttcgactggccgagtgtggccgcccgggtgctggaggtctacaccacggcgatcgaggcgaccgacggtcgggtcttcgacgccgacgaggcctgatcccgtcggggcaggtgacggccggacacattccggcactacgatcccacgtcatgtggtgggtgctgggtgccgtcgtgctgggtgcgatcctctcggcgtacctcggctggatcgcccagcgggtcgaacgggtgcacgcccgcgcccagtccgccgagcgggccctcgacgcccacctgctgcgccgggccgcggcggcggccgtggtcgccgagcgcaccgatgcggtggagctctacgcggccgcccggctggccctcgacgcgggccctgaggaacgtgagtcggcggagaacgacctgacccgccagctgcaggggatcgagctggacccggcggacaccgcggcgcgcacgctgatcgcctccagccgccgggtggtgctggcccggcaggtgcacaccgatctggtgcgcgacgcgctgaccgcgcggcggcgcaaggtggtccgggtgctgcggctgcccgggcgctatccgcgcccccgctacttcgacatcgtcgagccggtcatgccgccgctgccggtgtccgccgccacgcacgaggcgccgctgccggtccaggcggtctgaaccccggcgcggcgccccgtggcacggtcaccagccgcgctcggccaggcggtgcggctgcgggatctcgtcgacgttgatgccgaccatggcctcgcccaggccgcgggagaccttggcgatcacgtccgggtcgtcgtggaacgtggtggccttgacgatcgcggcggcacgctgcgcggggttgccggacttgaagatgcccgagccgacgaacacgccctcggcgcccagctgcatcatcatggcggcgtccgccggggtggcgatcccgcccgcggtgaacagcaccaccggcagcttgcccgcctcggcgacctccttgaccagctcgtacggcgcctgcaactccttggccgcgacgtacagctcgtcctccggcagggtctgcaggcggcggatctcggcccggatccggcgcatgtgggtggtcgcgttcgagacgtcgccggtgccggcctcgcccttggagcggatcatcgccgcgccctcggtgatccggcgcagcgcctcgcccaggttggtggcgccacacacgaacggggcggtgaactgccacttgtcgatgtggttggcgaagtcggccggggtcagcacctcggactcgtcgatgtagtccacgcccagcgcctgcagcacctgggcctcgacgaagtggccgatccgggccttggccatcaccgggatggagacggcgttgatgatgccgtcgatcatgtcggggtcggacatccgggacacgccgccctgggcgcggatgtcggccgggacccgctccagcgccatcaccgcgacggcgccggcgtcttcggcgatcttcgcctggtcgggggtgacgacgtccatgatcacgccgcccttgagcatctcggccatgccgcgcttgacgcgggcggttccgacggccggctggttctcagacatacgactcctcgtgcgggttgacgctggcgatcgtgcgacgctgcgggctttggtctcggcgatcgtacgaagcgggggcgggacgcctcgatagccaatcgaccccccggtggcctgctttagctcctggcccgcggcggtcctagagttgaccgggtgaacatcggagtgctggccctgcagggcgacgtgcgcgaacacctgtccgctctggccgagtcggacgtgctggcccgaccgatccggcggcccgaggaactggccgacgtcgacgcgctggtgatccccggtggcgagtccacgacgatgagcaacctggcgatcactttcggactgctcgacccgatccggaaacggatcgcggacggcatgccggtgtacggttcctgcgccggcatgatcatgctggccaccacggtcctggacgggcggcccgaccaggagtccttccagggcatcgagatgaccgtccggcgcaacgcgttcggccggcagatcgactcgttcgagggcgccgtggagatcgagggcatcgagggcggcgagttccacgccgttttcatccgcgcgccctgggtcgagcaggtcggccccgacgtgcgggtgctgggtcgcgtggcctccggggacgccgccggtaggattgtggccgttcggcaggggaacctgctcgccacggctttccacccggagctgaccggcgaccttcgcgtccaccggtacttcgtcgagatggtccgccaggccgcacccgcacggtagacacggaggttacgcatgtccggccactccaagtgggcgacgaccaagcacaagaaggcggtcgtcgacgccaaacgcggcaagatgttcgccaagctgatcaagaacatcgaggtcgcggcgcgtaccgggggcggcgacccgtccggtaatcccaccctctacgacgccatccagaaggcgaagaagtcctcggtcccgaacgacaacatcgaccgggccgtcaagcgcggctccgggctcgaggccggcggcgccgactggcagacgatcatgtacgagggttacgggccgaacggcgtcgccatcctgatcgagtgcctcaccgacaaccggaaccgcgccgccaccgaggtgcgcacccggctgacccgcaaccacggcacgttcgccgacgcgggcagcgtgtcgtacctgttcaaccgcaagggcgtggtgatcgtccccaagggtgagctgaccgaggacgacctgatgctggccgtcctcgaggccggcgccgaggagatcaacgacctgggcgactcgttcgaggtggtcagcgagccgaccgacctggtcgcggtccgcaccgccctgcagagcgccggcatcgactacgactcggccgagtcgtcgctggtgccgaccatgacggtcgaggtcgacgaggacgccgcgcgcaaggtgttcaagctgatcgacgcgctcgaggactgcgacgacgtgcagaacatctacggcaacttcgatgtctcggatgagacgctagctcaaatcgagggctagtctcgtgaggtgcgcgtccttggggtgatccggctcagccgggtgacagaagactcccccctcgccgcagcgacagcggcaagggcttgaggcttgggcgacagaccatgatcacgtgatcgtgggatgggctgaggacttggacgtctcgggtgacacggcgccttgggaacgaccggacttgggtcggtggcttggagacacgccgccggcccagttcgacatcatcgccggaatgaagatcgaccgcctgtcgcggaaccttcttcacctcgtccggctgatcgattgggcggctgagcgcggcaagtacgttgccgcgtacatggacagcgtcgacacgtccgacaagaccggcgaactgatcgccaaggtactcgcactcttcgctgagttcgaaggtacgacgatcgcagagcggtcagcacagtcccgggaacaccttcgccggataggccgctggcatggcggcacggcgccctacggttaccggcccgtccggaactccaaccgtgcaggtggggtgttcgagcatgaccctgataccttgatcgttttccgcgagatcgtcgaacgggtcaaggatggcaagagcatccgtagcgttgctcaggatttgaacgctcgcggtgttctatccccgcgggaccatgccgcggactctcttaggtctagtcggcgacctggaggtcatggagaagcgattcattcccggcgcggaccatacggaagaactccggaaagtcgataaggcactggaggcgttggagaacgaccgcatggccggcctctactccagcgaccgcggcgagcagtcctaccgtcgcatgcatggcagtctttccgctgaatatgaccgcttagcggctctacctcaggtcccggatcgctgggaagagattcctaccggcaggacgctccggcagtattgggaccgggccgaagatgttggcgaccgccgtgccttcctcaagaagatggggatagcggtcagggtgcatgccgaacctccgaccaggatgccgcttcgggtggcatttgggctacctgtcccgccggtagatatgccgcccgtggtatctgactccagatttgagctcctgcttcccctcgatcttgagccgcgtatcaaggcgcacgctggatcactggctaggaagccggaagccactccacctatcggctagtactgcgtcttctgtcgtcagcggtttgatgccggagtcggtggcaatgggtcaggcggctttcagtggacgctctgtcgcggccatctttcagcttggcaccgctgagtctgtcacacttccgacggttcaagatctagagagcttcgcctgaaccatacgggatcgctaggcgttgatatggttgcgagcccatgcgaggaggttggtgtgtcagtgccgcgggccgttgaggcgcgaagactggttggcaaattcgtgttgctggtggccggcgtgtgggccatgggtgccgtggcgttcatcgctaccgggctccaagggtcttggccgccgttgctgaacctgctggtgtacgtcgctgccggtgtcggcttggttctaggggcgtactactccatcaagctgcacctgactgccgaccgaagcgaggtagatcgccttctgtcgaaggctgtcggatacggacttgcgggtattgccgtcttcgcggttggcttctttctgatctttcatttcggaggttcgtcgtgacgttcagcgttgaaccatctgatgtgcgagcgtacgccgcaaagctctctgactactcagatgatgcggtcgaagctaaagcttatgctcatcggtatggggatctgagcgcaacagagggcggcatcctcggagccatcctgacgaagcatgctcaattcatgggacgattagatcaaatgctcggcacacttcaaaccctcacgcaaggcaaccatgaggccctcaaccggattgccaagaaatatgagtcgacagatttgaagtctgccactgaaatcgatcaggcgtatccggcgactcagcgacccattgtgcacagggactgaagtcacaggaggacgcatgagtaccgcagtaaaccttctggttatcccgggggaaccagacgacagcatgacagagggctttcccgacccaggagacctatttaactttttgtcaccatcagcctatatttctgcggcaatcgaaagtgttaccggatacgatgtttttgggtcggtgacggatgcaatagccggggattgggcctcgctctatcgcttcggcgatgccctgaagagcatggcgggctttctgcaagaggttggtatccagatccagtccggatttctggatctcgatcgaacatggtcaggaaacgccgacgatgcagctttcgtctacttcagcaatcttgcctcagcggtaagtcgccaacaggatgcgttggctcaagcatccaatgcttaccatgaatcagccaaaggtgcataccaattctctaaacagctcggaaacatcctccaggctttagttgatgccgcgcttctcatggctgcttcggcggcaatcggcaccgcaacggctgaaaccggattcggcgctcttgccggttatgggctggcggcatatcaggttacgcgggtgctggagttggccaataaggcggcaatcgtcgtctcaacggcatggacggccatcttcggtaccttcgggctgattgatgacctttccaaccagggcgggaatatttcggctattcctctcccggggaacgtcttcgcgcttccggaggctaagcgtggctgaccgtgttagtgagcaactcgaagaaatgacggataatcctcgaattgtccgagcaatgcgggacagtcttcagcagctcagcaagggtgccggtggccccgagctagccgagatggcggacggtgtcctgaagggaaacgtcaggatccgcgacatcgcacgtagctcagcttatggtggtgcgctcaccacggccttccagcggttccgtgagtgggaggcgaaccttgatccaccggagcgtcaacgtctcgcagagcaggcgcgctccatgctcgaggacgaccccgaagaacttgagcggaagaagactcgaaggtcttgagagattggttgccgcggtgccggtttgatcgctggtggtcttctctccaaacggccgaggggccgaagggctgacacggccgcggacacggcggcattactgttgtgcatggcggagacctctaccgtccacgctcgggggtgttccagcgcccgccggggcatcctcatataggagaagccatgaggacggttgtgattccgtctcgtctgaggtgcccgacgaggtaatggcgctcattgacgcgtgacgggtagtcgcggggcaagtaggctgaaggggtgctcctgttgaatgacccggtgctgcacctgtcagccctcgaggatctggacgtcgaggaccttgcccacctgccccgcggctatcgctacgaactgcacgacggaaacctcgtcatcatgacgcccgcctcctaccggcatcaggacatggctgggcgcatctatgtcatgcttctcgcggtcggtgcccgagcatttctcgatcctggagtgcgcgggactcgggagcgggactgtcgtctgcccgatgtcggtgtcgtcgccgctctgccgccgaacaccgccgactacgcgaacttgccaggttcggccatgagcctcgtggtcgaggtgatctcggagaagtcgccgaacggcgaattcacccacaaggccgactggtatgccgagcagggcatcgcggagtactggatcgtcgagcgggacgccgagaagtcccacgacgacgccacggtgcatattcaccggctggtgacccatggcgacaagccggactatttccgcgagcggactctgccgctctcccagctggagcgggagtatgccgcgaagcgggcggcaggctaggaaccggggccggcgagccaggacatggtctggatcatggtggcgatcaggagcaggccgccgatgatcagccggaggatccggcggtgctcggagcggcgccatgcgtgacaccaggccacggcggcgtcggcgagggtcagcagccccgctcgtgacgtaccgtcaatcagcgaagccttgcggagagcgagactcggcgccggaccgcccaccgggaccggaaacggcgccggggtgcgcagcacccggacctccacctcgtagacctgatcctcccgccatgcccgggtccgcttcaggatgcgctggcgcaggtagtcaccgggcacgtcggtgccggtcacccggctccagaaccgcaaccgacgccagtggccggccaggtcggtcagcgcctcctcgtagatcgcgtaacccaccggatcgccgccggtcaggcgcagtgcctcgcgccgcagcaccggctcgtgcgccgcgatcacctggacgaactccggtggcggatcgtcctgcatcggcgggatgacgttcatcgggacctcccgtacccatggtcgaggcgtgtcggcggcgggcgcaagagaaccgcgtactagggtgtcgaacacacgtacgtgaggggaggccgtgatgcgcgtgctcggcatcgatccgggtctcacccggtgcggcgtcggcgtggtcgagggggtccccggccgccccggcacgctgatcgcgtaccacgtggtccgcagcgagccggacgaggacatcgcgatgcgcctgctgcacctcgaccgcagcctcgccgagctggtcgccctgcaccagccggagagcgtcgccgtcgaacgcgtgttctcccagcacaacgcgcggaccgtgatgggcaccgcgcaggccagcgcggtcgcgatcctggccgggtcgcgggccgggctgccggtgcagacctacactcccagcgaggtgaaggcggcggtcaccggctccggcaccgccgacaagaagcaggtcaccgcgatggtcacccggctgctgaggctcgacgccccgccccgaccggccgacgcggcggacgccatcgccatcgccatctgtcacatctggcgcgggggcacccgcgcccggatccaggccgcggccgtggccgccgcccgcaggagcgcccgatgatcgccagtgtgcgcggccgagtcgccgcgatcctccatgacagcaccgtggtcgaggtgggcggtgtcggcatgcgggtcttctgcacgccgaacacgctggccgcgctgcgcaccggcgcggaggcccggctggccaccacgctgatcgtccgggaggactcgctcaccctgtacggcttcgccgacgacgacgagcggcagctgttcgagctgctgctgaccgcgaacggggtgggtccgcggatcgcccaggcggtactcgcggtgcatcagccggacgcggtgcgccgggccatcggcggcggcgacatcgcggcgctcacccaggtgccggggatcggcaagcgcggcgccgagaagatgatcgtcgagctgaaggacaagatcggcccggtcggcttcggcgatgccggcggcaccggcgtgctggccggtgcctggcaggagcaggtccggcagggtgtgctcgcactcggctggagcgccacccaggccgatcaggcggtcgccgcgatcggcgagacgatcgacggtgaggtcccgccggtgccgattctgctgcgccaggcgatccggctgctgggtaggacccgatgaccgacgacttcctgtccccggaggcgggcgacgaggaactggacgcggaggccagcgtccggcctcgccggctggccgacttcatcgcccagcaccgcgtccgcgaccagctggagctgctgctgaaagcgtcgatgggccgcggcaccccgcccgatcacatcctgctgtccgggccgcccggcctcggcaagaccaccctggcgaacatcgtggcggccgagctcgggaccgggatccggaccaccagcggtccggtgatcgagcgttccggcgacctggccgcgatcctgaccgggctgggccccggcgacgtgctgttcatcgacgagatccaccgcatcgccaagccggccgaggagctgctgtacagcgcgatggaggacttccgggtcgacgtggtggtgggcaaggggccgggcgccaccgcgatcccgctggacgtggagccgttcacgctggtcggggcgaccacccgggccgggctgctgagcgggccgatgcgcgaccggttcgggttcgtcgcgcacctcgatttctattccccggccgacctggacgcgctgctgcaccggtcggcgcggatcctcggggtgccgatcaccgcggcgggcgccgccgagatcgccggccggtcccggggcacgccgcggatcgccaaccggctgctgcgccgggtccgtgactacgccgaggtgcgcggcgacggggtggtcaccgaggagatcgcccgggccgcgctgcaggtgtacgacgtcgacgcgctcggcctggaccggctggaccgggcggtgctgcgggcgctgatcgagtcgttcaaggggggcccggtcggcctgtccaccctcgccgtcgcggtgggggagcagtccgacacggtggaggaggtgtgcgagccgttcctggtgcgggccgggctgctggcccgcacgccgcgcggccgggtggccaccgaggccggttgggcccatctggggaagactccgcccaccgacggcaggtccggggtgtttcagggtgacctgttcgcgcgagatgcgtgaatatccctcgtgatgtgaacgtgacgtgtgccgcattcgtagtctccaggttgaccgattagactcgcccccgcttcaacccggatgttttgacgccccggccccgccccgcagcggtcccggtggcctacggaaggctgtttctcgtgcacctggccgcgtcctccagctctaacccgctggggctgttcctgccgttcgtcctgatcctcggtgtgatgtatttcctgatgatccggccccagcagaagcggcgccgtgaggcgatggagatgcagaacaagctcggggcgggcgacgcgatcgtcaccatcggcggcctgcacggcaccgtggtgaccgccgaggacgacgtggtcctgctggagatcgccgagggtgtacaggtcacgttcgcgcgcccggcgatcgcccgggtggtcacccgcgccggcgagccggccgaggccgccgcggagccggtcgtcgcggagccgatcgtcgccgagccggagagccccgtcgtcgacgtccgcaagcaggactgacaaccgcatcacccccggaccggctcccggcgtccctgccggcgggcccggtccgccccggccgccgtccctccgtcgacggccggccaccgatcgagagcgctgcgcgcgtcgcgcggccggaacacagggagacctaacgccgtggcacgaccaccacagggacagatgcatcctggacgccaactcggcgtgctcggcctgatcttcgtcgtcctgtatctgttcgtcttcttcggcgggcacgccaagggcaccttcaccgatcgcctgaagccgaagatgggcctcgatctggtcggcggcacgcaggccacgtacatcgcgacgcaggccggtggcgcaccgaccccggaggcgatggcgcaggcccgggacatcatcgacaagcgggtgaacgccctcggtgtcgccgaggccgacgtcgtcatccagggcaagaacaccatcgtggtctccctggccggtgaggcgaaggaccagctcaaagacctgggcaaggccgcgaacatgcggttccgcctgctcaccggcaccaccatggacgtgtcgaagaacgcgctgaacccggcctcgccggcgcccagcgcggcagcgtccggtgccccgtcggtcgcgccgtccggtgcggccgtgccgaagagcggcgccagcgccccggccgcggtcgtcagcccgtcgaagggcaccggcggccagggcggtggcgaggcggtgccgagcgccctagctagctagccgcgcccgccggcccggcggccaccgaggctccggtcgcggcggacatcaccgcgcagcgtgccgcgatcgcgaagaaggtcggcccggcgatctgggcgcaggcccagcggctgaccgcaccggtcgagctgagcaccgacccgaaggccggcctgccctacaagccgttcagcacgctgagcccggccgaggtggccgcgctcagcccgcagatgcagttcaacgtgccgacgatcagctgcgaccagctgaaccagcggccgaacggctcgatcgacgacccggcgcagccggtggtggcctgctacagcagccaggccaaggtcatgctggacccggcgaaggtggtcggtaacgacatctccagcgccagcccgcagctcgaccagcagaacggtcagtgggtcgtctcgctggacttcaagagcgacggccagaagaagtgggccgacctcacccgggtggcgttcaacgcgacctccagcgacccgtgctacaccgcgatccagtcgctctacggcacgtcggtccagcactgcgcggtcgccgtcgtactggacaaggagatcctgtcggcgccgcagatcaccgcggtgctgaccggctcgtcgcagatcaccggcagcttcaccgcggcgaccgccaagcagctggccgaccagctgaagttcggcgcgatcccggtgaccttcacctcgggcccggcggagaccatctcggcgtccctgggtctgcagcagctgcaggccggtctgctggccgccgcgatcggcatgggcctggtggcgatctacgcgttcttctactaccgcctgctcggctcggtcatcttcctcagtctgctgctctccggtctgctcaccttcggtgcgctggtgttcctcggccggaccatgggctatacgctgtccctggcgggtatcgccggcttcatcgtgtcactgggtgtggcggccgactcgttcgtgatctacttcgagcgactcaaggacgagatccacgagggccgtacgccacgcagcgcggtgccgcgcgcctggcaccgggcccggcggacgatcatctcggcgaacacgatcaccatcatgtgtgccgtggtgctctacatcgtgtcgatcggcgcggtgcagggtttcgccttcgcgatgggtctctccaccgtgctcgacctggtcgtggtgttcctcttccggcacccgatcatgaccatgttcgccaacaccaaggcgttcctgtcgccgcgggtcagcggcctcggccgggtcctgcgccgcaacccgacggaggagcccggctcctcgcgtgtgaaggaggcctgagatggcccgtgaaggactcgcgtcccgcctctacgcgggtgaagcgaacatcaacatcgtgggccgccggaagatgtggttcacgatcgcggccgcgctggtgctgatctcgatcggcagcttcgtggtccgtgggttctcgctcggcatcgagttcgccggtggcacctcgttcagtgtcccggccgagatcagcggcaagagcctgacccagaacgagatctccgacgcggtggcgaaggcggtgcggtcggccaactcggaggccaccgtcggctcgacccagaaggtcggcaacggcccgggcgccagctacaccgtgcgagcctcggcgctgtccgcggccgagtcggagtcggcgaagaccaccctggtcaaggacctgggcgtggaccccgccaagatcagtgacaaccaggtgtcggcggcctggggcggtcaggtcacccagcaggcggtgatcggtctggtcatcttcctggtgctggtggtcgcctacctgatcgtccgcttcgagtggcggatggcggtggccgcgctcgcctcgctcgtcctcgacctcctgctgaccgcgggcgtgtactcgctggtcggcttcgaggtgacgccgtccacggtgatcggcttcctgacgatcctcggttactcgctgtacgacgtggtcgtcgtcttcgacaaggtgcaggagaacacccgcgggatcaccgcgggcagtgtccgcacctacagcgaggcgaccaacctggcggtcaaccagaccctgatgcgctcgctgaacaccggcctggtggcgctgctgccggtcggtggcctgctcttcatcggtgccggcctgctcggcgccggcacgctgaaggacctgggcctggtgctcttcgtcggcatgggcttcggggtgctctcctcgatcctgttcgccgcgccggtgctgagcgcgttgaaggaccaggacccgaagatccgggcgcacaacgcccgggtgctgacccggcgggccggccgctcggaggacgtggcccggggcgagcgccgcccgggcaacgccaccgactcggacgtcccggcgatggccggtagcaccaccccgcgcccgggtgcccgcccggcggcccggcgtggcgccaaccgcggcggcacggccggcaaccggccggacggcaagcggcgctgacaacgcggccggcggcagccggcaacggtacggaacacgggacggcccggcaccgcgtgagcggtggcgggccgtttcacgtcaggtcgatccgggcagcgggcgccggtgccccggcgggggcgcggtcgcgccgatccgctggtctaggctgtccgccgtgactaccgagatccccgcggcgcccggcgacagcggccccgagctggccgccctggtcgcgggtgccagcatcgacgtgccggacttccccaagccgggcgtcgtcttcaaggacctgatgccgctgttcgccgacgcggtggtgttccgccgggtgatcgacgggatcgcggcccatcacggggccggctcgttcgacgtggtggccggggtggaggcgcgtgggttcgtggtggcggccgcgctggcctatgccaccggcaccggcgtggtcccgatccgcaaggccgggaagctgccgcgcaaggccctgtccgcctcgtacgcgctggagtacggcgaggccaccctggaggtgcacgaggacgcgttcgtcgccggacagcgcgtcctggtggtcgacgacgtgctcgccaccgggggcaccgcggccgccgcgatggacctggtggagcgggccggcggcacggtggccggcttcaccgtgctgatggagctgggtttcctgggtggccgggagaggctcgccccccgtacagtgcacgcgctgttgaccgtttgatccgccttcgatgcatttgacccggccggtcctgctgattcagaggttcggccgggccattcgcgatggtggtgcgggtaggatggtcgttccagagggctacccctggatccattcggacctcgacggcgcggcacgcccggcggggttctggcgaaggtgatgaggaggccggtgtccagcgacgtcgtccctccggcggagggcacggtgcaaccgacccaggacccgcggaccggcacgggcgatgtcgcgcccgccgaggcccgcatcgatgacaagaccgccggcgatccggagaccacccagccattcacgccgaccggggagacctccggcttcgggttcgccagcgcgcccaccgggcgccgggtgcgggcccggctggcccggttcaacgcgccctggcagagcacccaggtcagcgaggtgctcgagccgctgatcgcgacgcaccgggcgagccaccccaagggcgacgtccgtcagctgcagaaggcgttcgacgtcgcggcccgctggcactcggggcagtaccgcaagtccggcgacccgtacatcacccatccgctggccgtcgcgaccatcctggccaacctgggcatggacaccaccaccctggtggcggccctgctgcacgacacgatcgaggacaccgactacggcctggagcagatgcgcaacgacttcggcgccgaggtggcgctgctggtcgacggcgtcaccaagctcgaccgggtcaagctcggcgacgcggccaaggcggagacgatccgcaagatggtcgtcgcgatggccaaggacccgcgggtcctggtgatcaagctggccgaccggctgcacaacatgcgcaccctgaccttcctgccccgcgccaagcaggagcagaaggccaaggagacgctggagatcctggccccgctggcccaccgcctcgggatgaacacgatcaagtgggagctggaggacctcgccttcggcaccctgttcccgaaacggttcgaggagatcaaccgcctgatcggggagcaccagccgcagcgggaggcgctgctgcgccaggtcaccaaccgggtcagcctcgacctcaagtcggcgaagatcaaggccgagaccaccggccgccccaagcacctctactcgatctatcagaagatgatcgtccggggccgggacttcaacgacatctacgacctggtcggcgtccgcatcctggtcgacacggtccgcgactgctatgccgcgctgggtgtgatccacgcgaactggcagccggtgccgggccggttcaaggactacatcgcgatgccgaaattcaacatgtaccagtcgctgcacacgacggtgatcggcccgaccggcaagccggtcgagatgcagatccgcacgttcgcgatgcaccgcacggccgagttcggcatcgccgcgcactggaagtacaaggagcagaagggcgcgacgatcgtcggcccgccggcgcacatcgacgagatgacctggctgcggcagctgctcgactggcagcgggaggcgagcgacccgtccgagttcctggacgcgctccgcttcgacctctccagccaggaggtctacgtcttcacccccaagggggacgtgatcccgctgccgaccgggtccacgccggtcgacttcgcctacgcggtgcacaccgaggtcgggcacaagtgcatcggcgcccgggtgaacggcaagctggtgccgctggagtcgacgctctccaacggcgacgtgatcgagatcttcacgtccaagtccagcaccgccggccccacccaggactggctcggcttcgtcaagagcccccgggcccggaccaagatccgccagtacttcaacaaggagcgccgtgaggaggcgatcgaggacggcaaggacgcgatcgtcaaggcgatgcgcaagcagggcctgcccctgcagcggatgctgaccagcgagaatctcacgacgatcgcgcgtgacctgcacctgcccgacgtctcctcgctctacgccgcggtcggcgagaacaccgtctcggcgcagtcggtggtcgccaaactggtcgccggcttcggcggcgaggagggcgcggtcgaggacatcgccgagaccgccgtcgcgacccgcccgccccgcaaccgcagcaccgcgcaggacccgggcgtggtggtcaagggcgtctcggacgtgtgggtgaaactggcgcgctgctgcaccccggtgcccggcgacgaggtgttcggcttcgtcacccgctccggtggggtgagcgtgcaccgggccgactgcgccaacgctcaggacctgcgcgagcaggaggagcgggtggtcgaggtcagctggaagccgacgtccgcgtcgacgttcctggtggccatccaggtcgaggcgctcgaccggcacaagctgctggccgacgtgacccgggtgctctccgaggagcgggtgaacatcctgtccgcgacggtcaccaccacgcgggaccgggtggcggtcagccggttcaccttcgagatggccgacccgaaacacctgggccacctggtggccgcggtgcgcaaggtcgacggcgtcttcgacgcgtaccgggtcacttccggagcctgaaagacgcgtacccgcttacttccgcagcatgaaagacgcgtacccggtcacttccgcaacatgaaaaaaggcggcccccgcgggggccgcctttttccgcgaatgccgagggtcaggagaccgtcatcgtcttgatgtcgagttccttcttcgggtgaccgccgccggccgactgcgcgaacgccccgtcgtcaccggccttcaccacgctctgcaccaggtcgagacccttggtgatcttgcccagcagcgtgtactgcggcgggagctgggtgttgtccgcgcagatgaagaactggctgccggtcgtgccgggctgctgcgtcttcgccatcgcgatcgagcccgcgggatacgggttgttcgtgtcggtcggcaggttctcctcggccatcatgtagccggggccgccctgaccgtcggtctcgcggtatcccttgccggtggcgaacgggtcgccgcactgcaggaccttgaagccgtcctggttgaccaggcggtggcacttggtgttgtcgaggaagttcttcgacgcgaggaacttgtagctggcgccggtgcacggggccttgctgaggtcgatcgtggcctcgatcgggccgaggttggtgtcgagggtcagcgtgctggtgccggtgttcggcaccgcggtcggcggggtgccgacctccttgaccttgccgccggtcgcgccggccggggtccaggtgcaggcgacggtgccggccgggagggcgctggcgccggcggtgggcttcttgtcgtccttcttcaggtggttgacgagcagcacggcgacaccggcgatcaccaccacggcgagggcggaaccgatgatcgcctggcggcggcgtcggttcttggcggcggtggcccgctcggccatctccttctcgagccgggcccgcgccgccgcgcgctgccggtccttgatcgacgacacgtcgttcctcctgctggtctcttccgaactcacgactgcacgctcgccgagggtgctgccgcgacagtgtctgcggcgacggtcaggctcttgatggtgatcttctccttgggagtgaccttgtcaccggcgctgtcggcgaccgtggggatcttggcgattttcgccagcgtgtccagcccaccggtgacctgacccaggatcgagtaggtcggggcggcggtcggcgcgtagtccttgaagaagatgaggaactggctgccgttgctgccggccgggttgccgatcgtggcgacggttcccttggggtagagcacggtgggtttggccaccgtgcccgcgccggcggaggcgctgggcgccggccggtccgggatgttctcgtcgtagtagctgtacgtcgggccgcccaggccggtgccgctcgggtcaccgcagtggaccgcgccgatgtcgaggacctcgtggcagggcgtgccgtcgaagaactgcttgccggccaggtacgagaagctggccgcggcgcacggggcgctcgcgacgtcgagcgtcgcgacgagcggcgcacccaggtcggtggtgaccgtcatctgctcggtgccggtctgcgggacgttcttggtgggcggggtgcccacctccttgagattggcgttcttcgacttgtcgaacggcgtccagatgcagtcgtcctgcgcctcggtggtggtcgacttgcccttgccgtcgaagacgccgccgatccacaggccggcggcgaccaccagcacgacagcgagcgcggtgccggcgccggccagcacgcggcggcgctgacgctcccgaacggcccggcgagccatctggcgatcgtatttcgcgcgcgcgagcttgcgctgccggtccttgctgggagccactaacgctgtccttccctgtgcatgtcaaggggtgcggcacgccacacgcccgcaagagtgtacgggtacctcctgagaaagtggtgtgcggctgccccgctactctcgttacgattcgcacccgttttgctgtgagggggatcggctcgtgctcgtcgccagctttccggcgcaggccttcggcaccaactgctatgtggtggccgccggcccgggcgagcagtgcctgatcgtcgaccccggcatcggtgtgctcgaccggttggacgaggtgctggcccagcaccggctgtccccggccgcggtgctgctcacccacggccacctggaccacaccttctcggtcgccccggtctgcggcgcccgcggcatcaccgcgtacgtgcacccggacgaccgggagatgctggccgacccgtcgaaggggctgagcaccgacctgagctcgctgttcggcggccgcctgcagtactccgagccggacgacgtcgccccgctgaccgacggcgcggtcctcagcctcgccgggctgcaggtcaccgtcgaccacgcacccggccataccggcgggtcggtgctgttccgcctgccgggcgcgggctcctcctgggacgcggaggagctctgtctctccggggacgtgctcttcgcgggctcgatcggacgcaccgacctgccgggtggcagcaccccgacgatgatggcgtcgctgcgggacaagatcctgccgctcgccgacgacaccgtcgtgctgcccggccacggaccggccacgaccatcggccgtgagcgcgcgtcgaacccgtacctgcgggacctgaccgcggcgcccggccgcttcctctgatcctttcgtcaggagagacagtgcctatttccggcttccctgagtggctgccgccccagcgcatgatcgagcagtacgcgctggacaagatccgttccaccttcgagctgtacggtttcgccccgctggagacccgcgccgtcgagccgctggagacgctgctctccaagggtgagacgtccaaagaggtctatctgctgcaccgcctgcaggaggacgagtccggcaagcgggaggaccagctcggcctgcacttcgacctgaccgtgccgttcgcccggttcgtcgtggagaaccacggcaagttggtcttcccgttccgccgttaccagatccagaaggtgtggcgcggcgagcgcccgcaggagggccgctaccgcgagttcctgcaggccgacatcgacgtggtcaaccgggacaccctgccgttccacttcgacaccgagatgccgctggtgatcggcgacgtcttccggtcgctgccgatcccgcgggccaccatcctggtcaacaaccggaaggtctgcgagggcttctaccggggtctggggctggcggacaccgcgcaggtgctgcggaccgtcgacaagctcgacaagatcggcccggacaaggtggcggccgcgctggtcgagacggccggggccaccgacgcgcaggccgcggcctgtctgaagctggccggcatctcggcggcggacgcctcgttcgtggacgcggtccgcgcgctcggcgtcagcgacccgctgctcgacgagggcctggctgagctggagcaggtggtggtggcggccaacgagcacgcgccgggcctgatccgggccgagctcaagatcgcgcgcggcctggattactacaccggcaccgtctacgagacccaattgcaggggtacgaacgtttcggctcgatctgctcgggcggccggtacgagacgctcgcgtcggtcggcaacacccgtttcccgggcgtgggcatctcgatcggggtgtcccggatgctcggcctgctgttcggacagaacgctgtgtcggtgtcccgcaccgtgccgacgtgcgtgctgatcgcgctgcccagcgaggagcagcggagcgtctcggagcggaccgccgcggcgctgcgccggcggggcatccccaccgaggtggcgccgacggcggccaagttcggcaagcagatccagttcgccgaccggcgcggcatcccgttcgtctggttccccggcgagccggacacggtcaaggacatccggtcgggggagcaggtcgaggcggacaccgcgacctggaccccgccggccgccgatctgcacccggtggtcaccggagcctgacgcgggcggcccgggacctgggcggcttctcaggccttgggcaggtcgaagatcaggcagctcgaggtcgcgtgggcgaccaggcgacctcgggcgtcggtcaggcgcgcctcggccagcgcggtgcggcggccgctctgcaggaccgtgccggtgcagcgaaccagaccggtgttgacggtgaccgcgcgcaggaacttcacgttgaggtccatgctggtgtagccgatgccggcgggcagtgtggtctgtaccgagcaggcggccgcggtgtccagcagggtggcgatgatcccgccgtgcacggtgccgatcgggttgtagtggaactcctgcgggtccagcgtgatcgtgacgctgcccggttcgacctccagccggttgccgccgatcagctggaagatcggcgggggtggcacctcgccggccgccatcgcctggagcacctccagcccgctgcgctccacgaacagccgcgcgtgctcggccgggtcggtccaggagaaggtgcgggtccggctcgccacgagcgatgcctgagtctgggtcatggacgcaggctggcacccgcttgctgcatctgtcaacgagacctagccttcacggcatggtcagccacgtcacaccgccggaagccctcgactgggacgtggacaactgcaccatctcgcgagccatggagatcctcggcgagaagtggacgatgctggtgctccgcgagatcttctccggcatccgacgcttcgacgacatgcgggtgcgtacccggataccccgacaggtgctcgccaaccggctgaccgccctggtcgcggccggggtgctgcgccgtgagccgtaccaggagccgggcgcccgggtccgccacgagtaccggctcaccgagaagggcttcgacctctacccggtgctgatcgccctggccggctggggcaaccgctacctggccgacccggccggcccgccgatccagttcgtgcaccgcgagtgcgcggccgaggtggatgtggcgatccgctgcgccgacggccacgacgtcaccgaccaccgcgacgtgctgccccgcccgggtccgggcgcccggcgccggggctagcgggccgagcagcgggcgatcgcgccggccgaggatcgccctcggtgcggcctctcctgccgtcagagcattcggattagccggatgtttcggttttgttccgattaacctcaacagtggccctgtcgtcacggggccctgctgaggaggcacggtggacgcccggctactgctgatcgggggcgccgccgggccggcactgctcatccgcttcgtcgagctggccgggtcggcgtccgcccggatcgtggtgatcgccaccgccagcgcggagccggccgtcgccgaggagtcctccgtcggtgccttccggcagctgggcgccggatcggtgcgcgcgctgcggctggccagccgggccgacgccaacgcccccgcggcggccgccgcgctgcgcgaggccaccggaatcttcttcaccggcggcgaccagcggcggatcaccacggtgctgggcggcaccgcgaccgactcgctgctgcaggagctggtggccggcggtacgacggtgctcggcgggaccagcgcgggcgccgcgatgatgtcggccaccatgatcatcggcggcgacggtcccggagtgaccgcggccagcgtgcagaccggtcccggtctggaattcctgcccggcgtcctgatcgaccagcacttcgcccagcgcggccggctgaaccggctgctcagcgccgtcgcgctctacccgcacgagctcggcctcggcatcgacgaggacaccgcgatcctcaccgacggcgaccggttcgaggtgctcggcagcggcgcggtgacggtcgtcgacgccggcgccgccaccgacatccgggtcccgcccagcgggccgatcgccctggccggagtgcgcgtccacgtgctgccggccggccacaccttccacctgaccggccgtcggccggggatcggggacacccctcatgaagatcgagagcctgcgccgcctgcgcggccccaacgtgtatctgtcccggccggcggtggtggcccggttgcgcctggaggagctgaccggccgggagacctctgacgtcaccggcttcaccgaacgcctgctgcgggcgctgcccgggctggccgagcaccactgcgcggccggcgcgccgggcgggttcgtcagccggctgcgcggcggcacctacttcgggcacgtcaccgagcacgtctgcctggagctgtcccagctgatcggccgggacgtcagcttcgggcgcaccgtgtcggccggcgagccgggcctctacgacgtgatcctggagtgcccggtcgacgagtcgcccgagtcccgggtgcccggcgagctgctggaggccgcggtggacctggtgctggcggtgcaggccgggcaggcggggcagccgccgcgcctggccgagctggccgccctcgccgagcgggaggcgaccgggccgagcacccgggcgatcatcgcggccgcccggcggcgcggcatcccggtcgagcggttcgacgacctgagcctggtccggctcggctggggcacccggcggcggatggcctgggccgcgatgaccgaccggaccagcggcgtcggcatcgacatcgccggcgacaagcacgtcacccgctgcctgctcggcgaggccggcatcccggtggcggccggcggcgcggcgaccaccgtggaggaggcggtgcggctgctggacgagctcggcgctccggtcgtggtcaagccccggcagggccgtcagggccggcacgtggtgctcgggctgggcacccgggaggcggtcgagcgcgcgttcggcgaggccggcggcgacgtggtggtcgaacggcagctcgccggccgcgactaccgggtgctgatggtggccggcgaggtggcggccgcggccgagcggatcgccgcgcacgtggtcggcgacggtacgacgaccctggccgggctggtcgagcggaccaacgccgacccgcgccgcggccccggccactcccgggtgctgacccggatcgcgctggacgaggtggcgctgcgggtggccgggatcggcccggacgacgtgccggccgagggggagacggtctggttgcgcgagtgcgccaacctgtccaccggcgggaccagccgggacgtcaccgaccaggtgcacccggacgtgacccggctgtgccagcgggtggtcgccctggtcggcctggacatcgccgggatcgacctgcgcctgccggacatcggggcgccgctcccgccggccggggagaccgagccggccggcggggtgatcgaggtgaacgcggtgcccgggctgcggatgcacctggccccggtacgcggccgctcgcgggacgtgggcgacgcgatcgtccgggcgatgttcccgggcggctccgacgggcggatcccgaccgtcgcggtgaccggcacgaatggcaagaccaccgtcacccggttgaccgcgcacctgctcggcggtggcgggcaccgggtcggcgcggccaccaccgacggggtgttcgtcgacggccgggcggtgtacctggccgacgccaccgggccgcgctcggcacagcaggtgctcggcgacccgcaggtggacatcgcggtgctggagaccgcgcggggcgggctgctgcgccgcgggctgggctacgactggtcggacgtcggggtgatcaccaacatcaccgcggaccacctgggtcaggacgggctggactcgatcgaggacctggcgcacgtcaaggcggtggtggccgaacgggtccgggacggcggcacgctggtgctcaacgccgacgacccgtgggtgcgcagcctggcgtcccggccccgggtgcgggccgaccggaaacgactggtctggttcgggctcgacccggggaacccggtgctgaccgagcacctgggccggggcgggaccgcgtacctgctgcaggacggttggctcgtgcaggccaccggggcccggcgcacgccgctgctgcgggtggccgaggtgccccggggcgtacggcggcgccgccctgcacggcgcggccaacgcgctcgccgcgatcgcggcggcccgggccctgggtgcccgcccggagaccgtggcggcccggctcagcgagttcgacccgggcgtcgacaacccgggccggggcaccctgctgcggctcggcgacgtctcggtcttcctggactacgggcacaacccggccgcgctcgccgccaccctgcgtaccctgcaccggctctggggggcgaaccggtgcgtggccgcggtgacgctgccgggcgaccggcgcgacgacctgctggccgcgtccgcccagattctggcggacgggctgacccgggccgtgctctacgacgaccaggaccggcggggacgcgcgccgggggaggtgccggcgctggtcgagcgggagatgcgggcccgccggccgaacctgcgggcggtccgcgcgaacgggttccgggaggcggtgaccaccgcgctggatctggccgagacgggcgacgtggtgctggtgatctacgagaagtgggggccgatgcgggccttcctgaccgagctgggcgccggcccggccggtgcccggccgatgacgccggtcaccgccgcggtgcgagccatcccacaactggtgtcaagcagtgtgacagatcatggacatttttgatctctctgcgtagtgattcattgaccgatcgtgtctgtctccacgatggagtgacccggtacttgaaacagcaagttccgacgaagcgggcaatccctaggtccgctcgtggcgctgcgtgaagaggcgttcacggaaagcgcattcctgaccattcggatacctctacacgccgctcggctgatcccacgcacggtaatgattgcctggtagatcgcatggcggagagctcgaactgacagccgtacaggggctaacatcctcgccgtcgatgggggatgctcgggatccgacaggtgagcccggctcgcccggcgtcaggcggcatggcggtgcggcccggcgttccttccaagcgcgcatgtgggggcacatgagcacggcggacctacccggttcgggactgctcgccgggcgataccggctggtcgagcggctcggtgccggcgggatgtcagtggtgtggcgagggttcgacgaagtgctgggccgtcaggtggcggtcaaggtcctcccgccgtccaccagcgcggacccgtcgttccggcgccgactgcgcgccgaggcgcaggccgcggcgcggctgagccacccgcacatcaccaacgtctacgactacggcgaggccagcacggtcgacggcgagcccgtgccgtacgtcgtgatggagctcgtcgacggcgagtcgctggccgccgtcctggcccgggtccgcaccctgccgtggaaccaggccgtccggatcagcgccgacgtggccgccgccctggccgccgcgcacgcgcgcgggatcgtgcaccgcgacgtcaccccggccaacgtgatgctcaccccggccggggcgaaagtggtcgacttcggcatctccgccctgatcggggagaacgacaccgacccggacggcagcctgctcggcacccccgcctacctggcccccgagcggctggaaggcggccaggtcagcccggccaccgacgtctacgcggtcggcctgctgatctaccggatgctgatcggtcagctcccgtgggacgtcggcaccaccaccgcgctgctgcgcgcccaccagtacgtggagcccgacccgctgccgccggtcgacggcctgccccgcgaggtggacgccctggtcggccgctgtctggagaaacggccggccgaccggccgccgaccgccgaggtggcgcacctgctcgccggcgtcgcggccggcgcccaggccgccgcggccaccggcttccggggcgactgggaggacagcggcgaggacaccacgatcctgccctccggctacccgtacgcggggatgggctagctagctaggcccccggccctgcgtcccggtggcgccgtgtcgccgtccgccccggccgacgaccggtccccggcccccggcaggcggcaggtgcgcacccggcgggccctggtggtggccggcaccatcgcggtgatgagcgcgctcacctacggctggagcctggccgcgcccggtgccggggacaagcgcgccgacgcggtcacgcccggcccgagcgtggtgcccgcggccggcaactgcatcgtcagctacgccgtctggtcgcaggagaaggggcgcttcaaggcccaggtgaccctggccaaccggggcgacaagccggtcgacgactggcagctgtggttcctgatgcccggcgaccagatcctgtccggccggtcgctgacccaggaccagcgggcggtcaccgtgcactcggcgagcaccctcgctccccagcagaacaccacggtcgagatcgccgggcggttcgccaagagcaacgccgccccgatgctgttccagctcaacggcaagacctgtcaggcgtacgtgtcgagttcacccggccagccctcccggccggtcgagcagctctccgacggctccgtgcggctcggcgaccccgcgtcggacagcacgccggcgcccggcatctcgatcgacccggtcggcatcgtgcacatcacgccgagcaccctgccggcgcgtccgtcgaccatcccgctgcccggcagcagctccaccgccaccgggggcggcggcagcaccaagccgagcgacggggcgtcggacaccgtccagccggagccggcccagtcgccgaccagcaaggcgccggtggagcagccgtccaacccgccaccggggctgcccggcgcgtcgctcgacggctgcgacagccaggactgctgaccttttccgcccggccgggattgcccggccgggacctgggtaccagggctgacggcgtcgtgaggttcggaaaaaccagaagccgaatccgggacgaccgagttacggtgaaaccgagaacgacaggcgctctgcttcgatccgctccgggtctcccgaccgtcagttttggcccggatcgcggttatttcgcacggcgtggctgccgaccgacaggccccccgcggggatgatgggcgaggaccgtgccgatgtcacgcacggtcacgtctgcgccggcgtgggtgcccgccggaccatcaagcaggtcgtcgcaacggggagttcgacaaatgatcagcattgtgaaggatctggccgccgaggcgcttttcgtctcctgtctgcagccgtccgagtacccgacccgccgcgcgctggaggacgccatcaccagcaccttgctgcagtacggcagcgacggctgcgccgcgggggtggccgccgagttcggtgaccacccggatatcgcggtccgccggatgcgctgggtgcaggccgagctcgccgaggtcatcacgttccgcgccccggctctccactgaggcgcaccaccccatcagggacgacccgcccggctgtggccagcgggtcgtcgtcttttccgcgctaaacctcaagcgggcaagatcgcctgaggtttttcatgaaaaaactccacaaaagcaaccgagttcggccgtcactgcacccgacggcgaccactgttcttctcgtcagccggtttcatcagccggttagtacaagcgaggaggactacgtgaccgccacgaccgaactccccgccaccatcggcgtcatccacgacgcgccctccgcgcgcgacatcgaggacctgatccgcgaacacatgccgatggttggccatctggtccgggaactgctcaaccgggtgcccggccacgtccacgcagatgacctctcatcagccggtttcgcggcgttgctcggagcggcccgctccttcgacgtgacccgcggcatcccgttccaccgcttcgccgcggtccggatccgcggcgcgctgctggacgagcttcggggtcaggactgggccagccgatcggtgcgggcccgggcccggcgggcggccaccgcccgccaggagctcaccgccgccctcggccgcacccccagtgacgccgaggtcgccgagatgctcggcgtggggatctccgaactggccagcgtcgaggacgacgtgcagaaggcgtcgctgctgagcctgcagggcttccccaccggggcggccgaggagatggtgccggaactgtccgagggccccgaggacctgctgctcaaacgggaacgcctcggctacctgcaccaggccatccaggcgctgcccgaacggcttcgccaggtggtcgaggagtcgttcctgcaggaacagccgctcagcgaggtggccgcgcggctcggggtgaccgagtcccgcatctcccagctgcgcaccgaagcgctgcgcctgctccgcgaggggctgaacagctcgctcgcgccggaactgctcaccgtcgcggccggtggcccgcgtacccgcaagggctgcctgcagcggcggcgcagcgagtatttcgcgaaggtgcagcagcaggggaacctgcacacccggctggcgctcaccgacagtcacggcgtaccgatcgcggtcgccgcgtaacggaggttttcggagggcgggccgctcgcggtccgcctttcctgtctcggtcgccccgtacccggggggcttcggagggcgggccgctcgcggtccgcccgtcctgctgaccgtcgagatccggcttgggtacgacgtgagcaccgcccccgatcgccacgcggtggggcacgatgtgtcggtgcgcgccatcgtgatcgactccgcccgtgcccggcccgaggtgcgggaggtgcccgagcccaccgccccgcccggcggcgtggtcgtccgggtgatggcgaccggcctgtgccgcagcgactggcacggctgggccgggcacgacgacgacatcaccttcccgcacgtgccgggccacgaactggccggcgaggtgaccgcggtgagcccgggggtgacccgctggcagcccggcgaccgggtgaccgtgccgttcgtctgcggctgcgggcgctgcgactggtgccggacgggtcaggcccaggtctgtcccgcgcagcagcagccgggattcacccacgcgggctcgttcgccgagtcggtcgccctgcacgccgccgacaccaacctggtcgccatcccggccggcgtctcgttcaccaccgcggcgagcctgggctgccgcttcgccacggcgtaccgcgggctggccggccgcgcccgggtcaccgcgggggagtgggtgaccgtggtcggcgccggtggcgtcggcctgagcgccgtgatgatcgcgcgggctctgggcgcccgggtgatcgccgtcgaccgcaacccgcgagccctggccgcggccgccgcgatcggcgccgggcacaccgtgctgaccggagccggcgtcgacgtccccggcgcggtggcggagctgaccgacggcggcagccacgtgtcggtcgacgccgtcggcagcgagcagacctgcgccgatgcgatcctcgcgctgcgccggcaagggcggcacgtgcagatcgggctgctgcccccggtcggcgggcacccgcgggtgccgatgtcccgggtcatcggatgggaactcgacgtgctgggcagccacgggatggcggccgccgactacccggcgatgatggccctcatcgagcagggccggctgcggcccgaccggctgatcgaacgcaccgtcgggctcggcgaggccgcggccctgctgcccggtttcgatcaggccaccgtcgccgggatgacgatgatcgacccggcccgctgagccggctgctcagaacaggaagtaccgctgcgccagcggcatctcggtgaccggctgcggctgcaccacctcgccgtcgacccgcacctcgccgctgcccgcgtgcacctcgatccggggcatcgcgtcgttcagcggcagatccgccttgccggccgcccgggtgtcgccgaccgggaccagcgcgcgtcgcaccccgatccggtcgctgagcagggcgtcgatcgcggccggcgcgacgaacgccagcgaggtgtgggccggcaccacgccatgggcgccgaacatcgggcggggcatcgccggctgcggcggcagggtcgacgcggctgcgtcacccgtctgcgcgtacgcgatcatgccgcctttgagcaccagcacgggacggacaccgaagaacgccggatcccagaggaccaggtcggcgagctttcccggctccacggaaccgacctgggcggccatcccgtgagcgatggccgggcagatcgtgtacttggcgacgtaccgcctgatccggttgttgtccgacgaaccgtcaccggcgagcggaccgcgccacgccttcatcgcatgcgctgtccgccaggtccgcaggatcacctcgccggggcggcccgtcgcccccgacccgatcatcgagacggcgccgagatcgtggagcagatccgtggccggcgtcgccgacccggccggatccgccgacgacggcagcacgttgggttgcgcggccaccgtgatcatcgccgccgcggccccggcgtggaccggccgtccgccgatcgcccgcaccgtgtcgtcgacggaaccggcctcgttgcgcgtgccggcgtggatcgccgcctgcaccccggacgcgtcacacacccgcaggcaggcgtcgatcgcggccggcgtgcagcccccatcctcgtggagcgcgaagccgccggccccgccgcgcaactgttcccacatcgcctccggcgacaccgtgtcaccgcggccgagcagcagcacgttgaccgggaaggtgtcgatcgccgccagcatccgggccagatgccagacgttcggggtgaccgtggctcccctggcaccctcggccggcccggtgccgccgccgacgaccgtggtgatcccggccgcgaccgcggcgtccaggacggccgggcggatcaggtgcgcccggctgtcgaccgcgccggccgtcaggatccggccgttcccggtgatgatctcggtgctcgccccgatcaccaggtccggatggacaccgtccatgatgtccgggttgccggccttgccgatcgcggtgatccggccgtcccggatgccgacgtccgccttcacgacaccccagtggtccagcaccaccaccccggtgaccaccgtgtccggcgtcccgtcggcccgcgccgcccgggactgccccaccgactcgcggatcacgccgaggaccgcctcgtcccccggccgtgggccggcactgcggtcctcctccacctccagcagcaggtcggtgtcggccagccggatccggtcaccggcggtcgggccgtacagcgccgcgtagcggccgcggtccagagaggtcaccgggggctcccgttcggctgggcctcaccggtgtcctcgtccagggacccggcgggttcgatgtcggccgggtccggctcggcgggcggcggcagcgtgtcgagcggcccgccggccagcccgcgcaaccccggcaccacccggttgccggcgagcggaatcagcaccacctcccgagcggcccccggatcgaaacacaccgaagtcccggccggcaccgccagccgatgcccccaggcggccgcccgatcgaactccagggccgtgttcacctcggcgaaatgaaagtgcgatccgacactgaccggccggtcaccggtgttgcgcacggtcaggtcccgcgtcacccgacccgggttgatcacgatgtcgccgtccccggccagaacctcgccggggatcatgcgatcggcccgggcacggcgatcagcctcggaccgtccgggaaggtggcttccacccgcacctcggcgatcatctcgggcacgcccggcagcacgtcgtcccgggtcagcacccgaccgcccgcggccaccagctcgtcgacgctccggccgtcccgggccccttccagaaggaaggcggtgatgatcgcggtagcctcggggtgattcagcttgagcccccgatcccgccgcttctgggcgacgtcggccgccacgtggatgagcagacgctcctgctcatgtcggctgaggaacaaagcacccccctgatcacgccacgagatggtcacccgcggagatttccaccaggcgactccgcttgatcaaaacacgcccgtccgcctccgccgggcggaaatggcaccgatcagcggggccggcggcatcagttctcggtgtcggagccgctctttccgcttccggaatcgttgttgtcctccccgccaccggtgccgccgctgtcatccttggacgtctccgtaggctgcgccgtcgtcggatcctctgccggcgcactggtctcgcctcccgcggtctccgtcggggtaggtttcccggtcgccgccccggtcggcgcggtggcgttcccgcccggcagagcgggcgcactcgaccgccgcggctgactcgaatgcccaccgccgttcttcaccgccccggtcgacggccggtgcgagacaaccgccgacggcttcaccgccccacccggagccccgcccgacggctcatccccgaaccagccgaacggatcggccagcgccacgaccgccccgagtcccagcagaaccagaaggaccacgccggcgacgaccagcccgcgcctggccccgccagcacctgccccaccatctgcccggccgaccgttgccccgcttgcagctgcccggccggctgtttcgtatgccggcaaggaggcctcgccctggctggtccctggggcgttgccaccggtggcgaacctcccaccggggcggcccgcaccgccgtttgcgaccgcgctccccgcagcggcacccgctgccagcgaagtcgccccgatgccagcccgccgcggcgccacgaccggtgaatccacgtcgctccgtggatccacgtcgctccgcggattcgctccgctctgtggagccgctgtcgctccgggcgccgaagccacatccagcgcggtgaagcccccgtcagccatcgtgtgtccatcacgcaccggaccgaccggcggacgatcctcataccgaggcgctcccaccatggcccgggcgacgattcccgcccccgccgctgccgccaccgcctgggtcacgtcatcccgtccgcctccaccggccccggcctccgtgttccgggcttggccggcgacgccggtcctggcggctgtgttctggttctgctcggcgatgtcggttctggcggccgtgttctggccgccggtcccgatcccggcgctctcggcagcgctcccgtcgctgatcccgggtgtggcgcttgtcgtctgaccgggccggtccggcatggtcccagagcctgccgtcgcgtcgattgccgtcgccgctgccggggtgccgggcgtcgagcctggggtggctgcggctgtcggggtgccgggcgtcgagcctggggtggctgcggctgtcggggtgccgggcgtcgagcctggggtggctgcggctgtcggggtgccgggtatcgagcctgaggtggccgccgccgcggggaagccgggcatcgagcccggggcggcggacagcgcagcgagcgaagccccggtccgcgcggcgacgcccccgccggcaatctcctgagcggcgacctccgcggctgcggccatggcggcagcggacgggaaccgttccgccggatccttcgcgagcgcggtcccgaccaggtcccgcacctgccgtggcacgtcccgggacagtggcagcggctcgtcggtgacgtgctgcagcgccacagccagcggattgtcaccgaggaacggcggccgcccggcaagacagtgatacgccaacgcccccagcgcgtagatgtccgccgccggccccgtggcctgcttggacacctgctccggagcgatgtacagcgccgtgcccaccacctcacgcgcgccggtcagcgtcatcgagttcgccgatcgggccaccccgaagtcgaccagcaccaccgtcccgtccggctcgatgatcaggttcccgggcttgacgtcccggtggacgatccccgcttcgtgcgccgcctgcagggctcgccccgcctgcgccacgatcgacatggtctcggccaccgacagatgtccccggtccgcgatcacccggttcagcggctgcccggccacatgcgccatgaccaggtaggcgccgtccccggtgtccccgaagtcgtacaccgccacgacacccggatggcgcagcgcggccatcgcccgggcttcgtgccggaaccgattcaggaacccgggatcagtcccatggtcaccgagcagcgtcttgaccgcgaccggccggcccagcacggcatcggtcgccgcccagacctcgcccatgccaccggccgcgatccggtcgtccagccgataccgtccaccgagcaactctccgggtgtaggcatggctgttcctctacccaggagagtcacgccctatccgcactccctccccaccggatgcgaacacccctcccatcgctgctctgaccagcctcgttccctccccccgcagccgcatccactgaacgcaggcccgcggcccccacgcctccaccgcaggcccgccgccctcatgtctccaccgcaggccacccgccaccggccacaccacgccagcgtctgcccgggctagctagctagggccgcgcgttccgcgctcgcccgcgacctgtctctgcctgcggctcgcgccttccgcgcccgtttgccgcccgcggcccgccgccttgcagccctgcagggccgtgccgcctgctgctcgccggcgggattcgccgtctgcggcttgcgtcgccgtgggtcaatcgccgacgtagaggatggcgtcgatctcgatgtcgaagccgaccagcgggaccgggagagtcgtccggacgggacggtgttcgcccttgatgtactgctggtagatctcgttcatctcggcgaagtctccgaaatcccgcaggtagaccccgacccgcacggcgtcgtcgaggctcgctccggcggcctcggcgaccgcggccaggttccggaaggcggcatgtgcctgctcggcgaaagtgccggtcacccgggtcccatcgggcagcgccgggatggcaccggccaggtagatggtgtcgccggcgacgacggcgtgcgagtacgggccgccgaccggcgccgccttgtcggtcatcacagcgcgcttgggcatcatgaactcctcggttgatctctcggaaactgttcggccagcccgtccaccccgaccaagggtgtggcgagcaggtcacggatgtggcgcgcccgctggtcgagggcggcgcgctgagcttcggtgagcgggatccacggtgcgggtggggccggcagccgcggcgggagcagggcgccgccgacgtaggtggcttcgttcaccaggcgcaccggcgagatgcggacctcccggtgcgcgtcgacgaccgggaactcctcgtcgcgtacccggaagatcgcgaggtcggcgggagcgccgatcgcgagggtgccgccagggagtcccagcgcccgggccgggtggacggtggccgcggcgatcacctcgggcagcgggacaccgaccgccaggagtttggccatcgtggtgggcagatcgaagaccggcccgtacagcgaccgggcgtgcaggtcggtggagacggtgtgcggcatcagccccgcgtcgagttgcgcctggaggacgtcgaaggcgaacccgccggagccgtgcccgagatcgaggagcacgccacgtccggctgccgcgtgcaccgccgggccgagtggggcggcgatgccgctggcgcagtgcgtcacgatgtcgcccggccgtagcaggtcaagcacctcgtccagccggggtggggcggtgccgatgtggaccatcaccggcactccgcaggcctcggccgcggtcaggccccggcgcagtggctcgatcccgttgtcgccgacggtgtcccggtcgatgcgcaccttgacgccgcggatgagttcccggtgggtctgaatggtgtcgatcgccagggggacgtcacaggtggccaggtcgcggctttccccggtgcggccggccaagccgattgccgagatgttgagcagggcgggcacccggacggtggccgcggccgcgacccggcgcagtccgtccaacgtgtacgccccggcggagccggcgtccacccatgtggtcaccccggagtgccacgccaccgggtcggggtcgattccccagtagcccggtccgacatgcgtgtgcaggtcgatcaggcccggggtgaccagtcgtccggagacgtccaccacgcggtgggcgtcgcggggcagggccggcccgatcgcggcgatgcgcccgtcccggatcgcgacatcgccgatgttgcgccggaccccggccggcccggggccggccggcagcagagtgccgccggtgagcaggatgtcgaacgtcatccggcaccgcccgccgtcagcgctgcctggatggtcagccggtagaggcgggtggggcgccccttgtggtgcggctgggcactgccctcaccggcgaccagaccggcctcgccgagtttgcggatcagccggcgcccgctcgggtcggtgatgccgagcgcccgggccagctcgcccggtgtgatcgcccgcccggccagggagcgttccagagcggccagccgggacatcgtcgccgcgctcagtccggcgcgcaccgcgagctcctccagaccgccgtgctcacgatacgaataggccaggggtggatcggccgcaccgatcgggccgatcatcacgccgtcctcggtgatcaggtagccggacgtggacccggcgcgctcggcgcgatccgccgcctgctcggccagcgccacgctgctgcgggcggacgcgccgatgccgaacccgaccgccgggccggccggatcctcgaccgtggcgtccggctccgccgccgggggctcgccgggctgtccgtggtcacggcgacctcggtggaagccgcccggcagactgacccaatggctggtgagggtctcgaacaccccggccggggcgaaggcgatgactgcgcgcggcccgtgctcgtcgatccaggcgtcggccagctcgggaagcgcggacagggcctgtcgcagggcctcccgggcaccgggcgcgggggcgcggaagacggcggcggcgaaccgttgcccgtcggcctgctgaccgcgcacccgggagaccaggtcgtgcagatccgcccggaccgtgccgggcgtggccatcgcctgcaggaccgctgtccgtccgtccaacgccgcggccaccccggtgcggacggtgatgacgtagggcgcggccgtgcgcgccaggtgctcctggtggaaggccaccacctcggcgatcggctgctcgggccggaacggaagggtggcgatggcggaacggtcgagggcgagcgcgtcggccacctcggtgaccgtctcgtcggggaaggtgtcgatgctgaccggggtggcgggccagccgttgccgcgggcccgggcccaggcgagggcgaggtcgagcgcggccgcccgggtgatcgcgacgggtagaccgggcggcaccagatcgccggctcgggcgtgcgggaccggcccgagcagcagaccgtcgagcgggccggcggccaggagcgtggtgacccggtcccggatctcctcctcccgctcgtagacggcccaggcgaaggagacgccggtcagcgtgcgggccgcctcggtgaagcggccccgctgacccgagtggaccacgatcccgatgatcatcgcgtctcttctggtggttcgtatgtggctcgtagtagcgtgctggaaaacgctccgcaggtcaaggaggcaggatgaacgagccacttacgagcatcgtgccgcgaccggcccgggtcacgtccggcgagggcgccttccacctcggccccgggaccgcgctggacgccgggcccgccctgaccggggtggccgcctggttgcgtggcgcgctgggccgggtgatcggcggccaccttctgcccgggccggacgggatccggctgcggacagttccggagcttgcaccggaggcctatcagctggaggtgcgcgataccggcatcgagatccggggcggctcaccggccggcgtcttctacggcgcgcagactctccggcagatgctgcccccggtcacgctacgccgcgcgcgcctgaccgacggcccgtggacgattcccgccggccgggtcgacgatgcgccccgcttcccctggcgcggcgtgatgctggacgtcgcccgccacttcatgccggtcgccgacgtgctccgcctgatcgacctgatcgccttccacaagctgaacgtgctgcacctgcacctgaccgatgaccagggctggcgactcgaggtgcccggccgcccacggctcacctcgatcggcgcctggcggccggccaccatgctaggctcccgccggcacgagcggttcgacgcccgcccgcacggcggcttctactccgacgacgacctgcgcgagatcgtggcctatgccgccgaccggcacatcaccgtcgtccccgaggtcgacatgccggggcacatgcaggccgccatcgccgcctatccggagttgggcaacggcttctccggcgacgtccgggccggctggggcatctccccgcacgtgctcaacctgggaccggaggcgctcgacttctgtcgcaccgtcctcgatcacctctgtgacctcttcccgagcgagctcatcgggatcggcggcgacgagtgccccgccgacgagtggcatgacagtccggtcgcccaggcccgcatccgggccgagggtctgggcgggccggatcggctgcagccctggttcaccacccggatggccggccacctcgccacccggggccggcgcgtgttcggctgggacgagatcctggccggtggcgcgccgcccggagcggtgatcgcggcctggcgtgggcccggtcccgcggcgcacgcggcccgggcggggcatccggtggtgtcgtgtccggacatgtcggtctatctggactatcgccagtcggacgaccccggagagcccacgccggtgggcacccggctgaccatcgaggacgtcttcgcgttcgatccggtcccgcccggtctcactccggcggagaccgcgctggtccgcggcggtcaggccaacctctggaccgagcacatggagtccgcccgccgcgtcgactatcaggcctttccgcgcctgtgcgccttcgccgaggcggtctgggggccggccgagcgagacttcaccgagttcatcagacgcctgccggcacacctggaacgcctggatgccctcggtgtgaactaccggccgctgagcgggccgcgaccgtgggacgcgcgaccggacgcgcccggcaatccgcgtacgcgcaatgatcgtctcgcggaattgcgggagatgaccgcggacctggagcgggagcggtcatgaccaccgcaggcggggtgggtcggtcatggcaggcggggcagcagcagactcgccaggcgcaacggccgcccggtggcgatgccgtcgccggtggcgttccacacttcggacagcaccgcttgtacgaaaccccaggcgaccacccgctcgatcgggatgtcgagcccgtcggcgagctgctcgatccgccccggcaccaggcgcagcaccgtgtcgtcgtccatcgggtaggggttgtagagcatggcgccgatctcgtaaccgggatcgccggtcagcccgtgaggatcgatcaccagccacggctcgcggcccgcggccagcacgttgtcgtggtgcaggtcaccgtgcagcacgacgcgctcgatcgcggtctcgcacagttcggtgagcagccgcccggcccgctcgaccaggtgtcgcggcagcgggccgtcatccgggaaacgccgcagatgctcgtcgaaggtggcgcggcgggcggccagctcgggcagggcgatgccgggcggcgcggggcggtgcagtccgcggatcaccccgatcagtgcggctgtcgcgtcctcgtcccggtccggcaccagcgatcgggccggccggcccgggcggacctcctccagcaggatcgcgccgcgtgcggcatcgtgggcgagcatcgacaccgcgcctcgcccggcgaagaactccagcgccgccgcctcgtccgacagatgatccgcgccggggatgcccatcttcagcaccgcggcggatccgtccgcccggcgcacccgggtcacccagttcaggctcagcggacagggccggtccaggtggagatcccagtcgtgcagcacccgggtggctatctccggcagatcagccagccagcgggtccccggagcgccccagcactgcgcgacgcgacgcgtgaacgagtccggcagcgcgatctccaccatccgtgcagtctcgcaaccggcgacgacaccgcgagcgaagggagccggaagtgacgatcgactggcggagcaaaggattctggctgccgcacggcggccggaccgccgagcagatcgcgtccgaacggccgagcatcttcggcggcggtttcacctggccgctgctggtgatccggcaggccgcggtcgaggcgaacatcgcgacgatggccgcctactgccggcggcacggatgcgacttcgccccgcacgccaagacgacgatggcgcccgggctgctcgaggcccagttgcgtgccggggcgtggggcctgaccgtggccacggcgaatcaggctctggtgctgcggcggctcggggtgcagcgggtgctgatcgccaaccaggtgctcgacccgatcgcgctgcgctggctggccggcgagagtgacgccggctgggaggtgtatttccaggtcgactcactggccggggtgcgcgcggcggccgcggccggacggatccgggtcctcgtcgagctggggcatccgggcggccgtaccggtgtgcggacgctggacgaactggaccgggtggcccgggccgttgccgccgcgccgggggtcgagctggccggactgaccggctacgaggggcagcttgccgacctggcggaggtcgacacctatctggatcggctggccgcggggttcgagcagctgtccgctgccgggctgctcccggaggagccgatcgtgtcggccggcgggagcgcctggttcgaccgggtcaccgatcgtctcaaggcgcttgccccgcgggcgcggctgatcctgcgcagcggggcgtcggtcacccacgacgacgggttctatcgggagcggacgccgttcgtgcgcgtgcccggcgaaggaccgctcaccgcagccctggaagtctgggcccaggtgctgtcggcgcccgagcccgggctggcgctcgccgggatgggcaagcgggacgcgccgttcgacgaggggctaccggtgccgggggaggtgcggcggccggacgggacgacggcgccggccgacgggctccgggtgacccggctcaacgaccaccacacctatctccaggtggccgacgggaccgtagtggagcccggtgacctggtgcggttcgggatctcgcacccgtgcacggcgttcgacaagtggcgcgacatcccggtggtcgacgagcagcggcgcgtggtggacgtgctccatacgtacttctgagccgggtttttgtcatacctcggcggaaggatcagggtgtgacggcgagagggtcctcatcggtgattctggttcttcctcgatgtccgattcgacgagcagacgggcgtaattggccatggagcgctggtatcgaggcaggtggcgagcgagagcaccgaccgcgatggcgacggcttcgcgctcgcggcccacatcggtcaaagccagggcgagcacggtcttcaccgcgtcgtccagatgatccgacccggcggcaagctcgacggtgagcagcgcgacgctttccggcgagcggcccaggttgcgcagggaactggccatctggatgacggcgcggcggcggcgttcgccggtcagaccggcggcgagggcccgctcgtacaggggtatcgcaaggtcggagctgccggtggagtcgaacgcggcagcacgctcgaaggtgccgtcggggtcgccgtccggcagttcggcggtgacgtcggtgatcgcttgacggaagtcggtggcgtcgcgttcgtcgatcgatgcccagaccgcggccagccgcgcttcccattccggtgtcgtcatccggggagaatcgcacggtttgatctgtggcgctgcgagcgggggtgatgcttcggtcgtccgcagcctgttcgggtggggaaagtagtgcggagtgggccgtaaagtccggtcaatggggtgggaggggctgtggcagtggggtgatgatgtcgctcgtctcgaaccgcttgccgagggagtggccaacgacgtgtggactgtgcgggtcggtggtcgtgtcgcggtcggtcggctcggagtcaggagcgacgccgatctcgcctgggaaaccgggttgctcggccatctccaccgtgcgggactgaccgtgccggtgccgattcccaccgtggacgggcggctgttcgccgccggcctggtagtgatgacgcatgtggagggcgggccgcccgagacccgggacgactggcgtcgcgtggccgaaacgctccacaagctgcatcggttgacgcgggactggccgcagcgtccggggtggcgatcgtccggcgatctcctgcacgctgaaaccgggacgaggatcgacctgcgggcgatgccaccggaaggggttgcgcggtgccgggcggcttgggcgcggctcgtcggacgtccgacctgtgtcgtgcacggcgatctcaatccgggcaacgttcgcatgaccggggaacgcgtcgcgctgatcgactgggacgagtcacgggtcgacgttccggagctcgacctggtgctgccggacaacgctgccggtctggacgatggcctgtacgacgtggccgcacaggcttcggcggcgtgggaggccgccgtgtgctgggaggacgactatgcggtcaggcggcttgccgaggtgcgagcccgctgagagcgcccttcagggaaattccgtcgccgcgaccaggtggtcgtttgtggtgcggcggggaggccacggtcccgggatcgcggtcccggggtgcgaaaagcgggtgacggaagatgttgaccttggaactctgggcggcgtgatggagacgatgacgttgtggcggccgacggggccggaggaatgggagctggtgcgggcgtcgggacggaagcggtggccggcgcggctgccggatcagccgatcttctatccggtgctgaacgaggactacgcggtgaagatcgctcgggactggaatgtggcggcttccggggtggggttcgtgaccaggttcgagatcgatgcggcgttcgcggcgcggtatccggtgcggcaggccggggggaacacgattctggagctctgggtgccggcggaggagcttgcggaattcaacgaccacattgtcgggacgatcgaggtcgtgcacgagtttcggtgacgtgtccgcgattcttgccggcagggcacggatcaggagcgggtgccgagtgggggtgggaagtgacggggcgggtgttcgggcagggtgcctatcgggggcggttcgagtgggggctgtcgggggcggaggccgtgacgccgggggtggcggtggtggcggtggtggatgttctgtcgttcacgacggccctcagtgtggcggtggagaacgggatcgcggtgatgccgtatccgtggcgggacggcacggcggcggcggtggcgaggcggcatcgggccgagctggcggttgggcggtccgtggccggtccggacgaggtgagtctgtcgccggcggtgatgcggcgggtggcgtcgcggcggcggatcgagcggctggtgttgccctcacccaatgggtcggcgatctcggcgcggctcgcgcggcttcaagatcccgacctggcgagctccgggttggtgggggcgaattcgcagccgatgcgcacaggcttggagccggtgggggcgaactcgcagccgatgcggacaggcttggagtcggtgggggcgcatccggaggtcgtgcggggcagcggcggggtgaccgttgtgggggtcgggctgcggaacgcggcggctgcgcgggagtgggtgcggcggcgggccgaagggcgggccgttgcggtggtggcggcgggggagcggtgggtggacggttcgctccggccggcggtggaggacctctggggagctggggcgttcctggacgggatggatgggctgtcgccggaggccagcgcggcggtggcggcatatcgagcggtggcggaccggatcggggaagcgctgcaggcgtgcgcgtcggggcgggaactggcggccgccgggtttgctgaggacgtcgcggtggctgctgaagtcgatcaggcgactgcggtgcccgtgctgcaggacggctggtaccggccggggaagtgaggcgcgtccgggtgaggtcggggaggcagggcgcggaggtgagaccggaatgagagacaggagggcagcccgcggcggtcagccgcggggtggtcgccttgctgggggatgttgctgggcgatcatgagtctttagcgttttgggaggtttttgccactccgccgctggagacctttatgcctgtctttcgtgcagccagtcatgccggtcataccggtcgtgatgatcgcggccggtgggtcgcttcctctgatggtgatggtgagggggccgggcgacttccgggcgccgccgagagaaggcctggtccggctggttctgagccggatggggaagtggcgggtccggcaaagagcagggcagcggcggtgccggtaaggagcccggcagcggcggtgccggtaaggggcccggcagcggcggagccggtaaggggccgggacgcggcggctccggccagaggcggggaggcggcgatccggccagggggttggcttgccggtgacgtgcgggtggtttcagcgcgcgccactgtgcccggggcgccgtccgggttgacgggtgaggtgacccaggtcgatgcacgtcctgcggggcgcggcgcctcgcggacgccggacagcggtgcgttcgcggggggagctcaccccttggacgtaggggaggccggggaacggcttgtccccgagccggtgggtatccggcatgtacgggtgccggcagcgggatccgagaccgcagcgcgggtcaccgatggcggcgaagggcggatcaggcccgccgccttgccggagcgtcctgctcagcctgtacccggccggctacctgagcagcgttccggctccgatcagccggccgccgacgagccgcggtcaaggaccggcggcaccggaaacccgcgatcaagagccgtcggcggtggtcagccgcagcccggaaccgccggtggcgcggtgccgcaacaggggtcgtccggcgacgcgacaccgcaaccaggaaccgtcagcggcagggagcagcatgcaggactcgtcgaccacacgaagccgcaaccaggacccgtcagcggcggggagcaggccgggaccgtcagcggcagggaacaggaagcaggaactgccggcggcggggaatccgggccggtcgtgaccgcggccagcggcggcgggcaagcgcagcccggcccggcccccgctcacccgcgaccgggtggccggaagggcggccgcgggatcgccgtcgtagccctggtggtcagcctgttggcgttggccggcaccggcaccctcggcttcctcgcctatcctagctagctagcggccgggtcgggcgcggcggaccggcccgtgacgtacgccaaagaggctctggacgtgcgcatcggctgcgccgcggtggtctacctcgacctggacgaacctcgcgccggggtcggggcgcagatcggggatctgcggtatgacagcaggtgcggaaacggcccggcccggctgagtctgggggcgggcgcgaccgccggcagcagtgtcgcccgaacggatctcgacgatgacggctgtctgcgggccatccggaacgggccgctggagccgggggccgcggtgaacgtcagggtgggcacggccctctgcgtgctgacggcggcccagccggcgaagctcgtgctggtggagatcgccggggtgggggtgaccgggaatctgagcctgcgggcgacgtcctggctggcgcctgcttgaggggtgaggcggggggagagcgggaggactgacagaatgtcgggtgcgccccgcgaaactcggtgaggagacatttccgtgatcaggacccatgacgccggcagtctgcgtgccactgacgccggcacgacggtgacgcttgccggttgggtggcccgccggcgggaccacggcggtgtcatcttcgtcgacctgcgggatgcctccggtgtggtgcaggtggtcttccgggaggaggacgcgcacgcactgcgcaacgagttctgtgtgaaggtcgtgggtgaggtcaacgcccgcccggccggcaacgagaacccggatctggccaccggcgccatcgaggtggtcgccagcgagctgaccgtgctctccgaggcggccccgctgccgctgccgatcgatgacgcggtcaccgcctcggacgacatccggctcaagtatcgctatctcgacctgcggcgttccggcccggcgaaggcgctgcgcctgcgcagccgggcgaaccagatcgcccgtgaggtgctgcacgcgcacgacttcaacgagatcgagacgccgaccctgacccggtcgacgccggagggcgcccgcgacttcctggttccggtccgtctgcagcccggtgcctggtatgcgctgccgcagtccccgcagctgttcaagcagctgctgatggtggccgggatggagcgttactaccagatcgcccgctgctaccgggacgaggacttccgcgccgaccggcagccggagttcacccagctcgacatcgagatgtcgttcgtgacccaggacgacatcatcgcgctgggcgaggagatcgtcgccaagctgtggagcgagctcgccgactaccaggtgcagctgccgattccgcggatcacctggaccgacgcgatgaaccgctacggttccgacaaacccgatctgcggtacggcgtggagctcatcgagctcaccgactacctgcgtggcaccgagttccgggtcttcgccggcgcgatcgacgcgggcggctacgtcggcgcggtcgtgatgccgggcggcgcctcgcagacccgcaaggagctggacggctggcaggactgggcgaaggcgcgcggcgcccgtggcctggcctacgtggtgctggacgcggagaccggcgccccgcgcggcccggtcgcgaagaatctgtccgaggcgcacctggcggggctggccgacgcggtcggcgcgaagccgggcgacgcggtcttcttcgccgccgccaccgagcgccgcgaggcgcaggagctgctcggcgcggcccggatcgagatcgccaagcgggccaagctgatcgacgagagtgcctgggcgttctgctgggtcgtcgacgccccgatgttcgaaaagactgacgagggcggctggaccgcggtccaccaccccttcacctcgccgaacgacgagtggctggacaacttcgagtccgccccggacaaggcgctggcgtacgcgtacgacatcgtcgtgaacggcaacgagatcggcggcggcagtgtccgtatccaccgcggcgacgtgcagagccgggtcttcgacctgctcggcatcaccccggaggaggcgcaggacaagttcggcttcctgctggaggcgttcaagtacggcccgccgccgcacgccggcatcgccctgggctgggaccgcacctgcatgctgctcggcgggttcgactcgatccgcgaggtcatctcgttcccgaagagccgtggcggcttcgacccgctgaccggcgcgccgaccccgatcaccgcgcagcagcggctggaggcgggcgtcgacgccaagccgaaggcggccgcgggcacgccgggcaccgacggccaggccgccccggtggagcgctccaactagacgcggcacgcaggcggccccgcatccgacgaagctcagaggatgcggggccgccgctgttttgtgagactggtcggcgtggagccgaccatcgtccagtgcgccgagcagccctatgtcggccgtcgtgagtcgatcaccatgaccgagttcgcgcgggtcgccgaccatctgcccaccatgttcgccggcctggggcggcgcggcgtccgggtcagcggcgccccgttcttccgttaccgggtgatcgacatggccgccgagatggtggtcgaggcgggcattccggtcaccggtccggtcaccgtggagccgccggatttcatcgacacgctgcccgccgggcgctatgcgacggtcagccacgtcggccatccggaccaattgatggcggtcaccgcgcggctgctcgactgggcccagcgcaggggcctgacctgggacatgaccccgacgccgaccggtgagcgctgggccgcgcggctggagatgctgatgaccaacccggccgagcagcccgacatgcacaagtgggagaccgtcctgctgttcaagctggcggattgacaggtcacaccacgattgacgccgtacgggtgatcaacgcgccgccggggcccccgacgagctgcgtggggtgtgccacgggctggtgactcccggtctgctttcctcgaccgctgctgacgacgtacccaagcggctttgcataagttcgttgcacagatattgtgcatggtatggcggacaagctcatcgaagtgcggctcaccggcccgcagatccgcgcgttggcccagccgctgcgtctgcgactgctcggacggctgcgccaggccggtccggcgacggccacccgcctcgccgccgacctggacaccaacaccggcgccaccagctaccacctgcggcagctcgccgaggtcggcctggtgatcgaggaggcgcggccgggctccggccggcaacgctggtggcgtgcggcgcacgacacgtcccacttccggcgcagctactacgaggacgatccggaggccaccgcggccgccgagtggctcgagacgtatcaggtcagccacttcgcccaggccgcggagaactggcggcgcgccctgcccggcgagccggagagctggcagaacgccgccgggatctccgactacacggtgcacctggacgccgcccgcaccgaggcgatgatgcgcgagatcgaggcggtgatcgagcgctaccggcaggcgggccaggacgatccgcggcccggcacccgcccggtgatggtcgtcgcggccgcgctgccgagggtcgcatcatgagccttccggcacgccaggtccgcctgcgctacctgatcctgatcacgctccgctggctccccgtcggcctgaccatcccggtgctggtgctgctcccgctggaacgcggactcaccatcgcccaggccggcgtggtcaccgccgtccagggcgtcaccgtcatggtgctggaactgccgaccggcggattcgccgacgcgctcggccgccgcccggtgctgttgctggccggcgcggtcaacctggtctcgctgagtctgtactgcgtcgcccacacggtcgggttcttcgccgtggcctggatgctgcagggcgtcttccgggcgctggacagcggcccgctggactcctggttcgtcgacgagtcgctggcggcggaccggaacgccgacatcgagaccgggctcagccacggtgaggtggtgctcagcctcggcatcgccggcggcgccctgatcagcggcggcctggtctggctcgggccgatcgggccggtcagcgcgctcaccgtgccggtggcgctgtccatcctgctcagtctgctcagcacggtggcgatcgcggtgctcatgcacgaggagcggcccgctctcggcctggccgcactgtccgcctcgatccgcggggtgccgatcgcgatcggctcggcgcttcgcctggcccgccgctcccgggtggtgctcgcgctgatcgcggtggagatcctgtggagcttcgggatggtctccttcgagaagctgatgccgatccggctcagcgaggtgctggccgacaaggacgccgccgcctcactgatgggaccggtcagctcggccgcgtggggcgcgtcggccgccggcgcggccctgatccccctgctcgtccggcggatcggcgcaccccggaccggcttcacgctgcgcctgctgcagggcgccacggtggtggggatgggcgtcctggccggcccggccggggtggtcaccggcttcctgctcacctatgcggtgcacggcgcggccaatccggtgcacaacgcgctgatgcaccggcaggccgagggcgaataccgcaccagtctgctgtcgctcagctcgatggccagccagcccggcttcgcgatcggcgcgatcctgctcaccgcggtcgcgcagagtgtcagcaccagcgtcgcgatcgtggccggggcgatcgtgctcgcggccgccgcaccgctctatctggtgaaacccaagtttcacgaacccatcgacgggggtaccagcctgacatcggctctcacccccggaggaacctgatgctcgccatcgccgccgccgtcgtcttcggcgtctactttctttctgacctgctgaacaacaacttcggcgtgcccaacctgatcaacttcccgacgatggcgtcgctgggcctgctgctgctgtcgctctacctcgcgggtgtcggccgcggcccggcgaccggctccggttccggccgccggttctacggccgccgccccggccggggctgacgcaccggctccgaacccggcccgcgcgcacccactgaagtaacggtgcgtagcgggccgggagcttatccacaggcggcgctttcgcatttcggatcgcccccgagaggccggtactgtcggttgcgatggaaacggacgggcttttctccctcgcgcagccggacctgccgccgccggcgcacaccgctgccgccgccggcttcggcgccccggcggccgacgcgccgctgcccgtccggatgcgcccggccagcctcgacgagctggtcggccagcagcatctgctcgcccccggtgccccgctgcggcagctggtcaccggcgccagcccgatgtcggtgatcctctgggggccgcccggcaccggcaagaccaccatcgcgcacctcgtcgcgcacgccaccgaccgcaagttcgtggccatgtccgcgctcaccgccggggtcaaggacgtgcgcgcggtgatcgacacggcccgtcgcgagcgccgcgccggcggcccgccgaccgtgctgttcatcgacgaggtgcaccgcttcagcaagacccagcaggactcgctgctcgccgccgtcgaggaccgcacggtcaccctgctcgccgcgaccacggaaaacccgtacttctcggtcatctcgcccctgctctcccgctgtgtgctgctcaccctgcaggccctcgaggagtccgacgtgcgcgccctgatccggcgcgcggtcaccgaccagcgcggcctgggtggcgcggtcacgctttcccccgaggcagaggaccacgtggtacgccttgcctcgggcgacgtccgcaaagcactcaccgccctggaagcggccgccggttccgcggtcgcccagggctccgccgagatcgacctggccaccgccgagcgcgcagtcgacgtggcagccgtccgctacgaccgggacggcgacgcgcactacgacgtcatcagcgcgttcatcaagagcatgcgcggcagcgacccggacgccgcgctgcactggctcgcccgcatgatcgtcgccggcgaggacccgcggttcatcgcccggcgcatcgtgatcttcgcgagcgaggacgtcgggatggccgacccgcaagccctgctcgtggccaccgcggccgcccaggccgtgcagctcatcggcatgcccgaggcccagctcaacctcgcccaggccgtcgtgcacatggccaccgcccccaaatccaacagcgtcaccgcggcgatcggcgcggccatgaccgatgtccgtgccgggcggggcgcagcggtgcccacccacctgcgcgacgcccactactccggcgcgcgcggcctcggacacggccgcggataccgctacccacacgacgacccgcgtggcgtcgtccgccagcagtacgccccggacgacctcgtcggcaccgactactatcggccgaccgaacacggggccgaacgcgccgtcggggagcgggtgccgcgcctgcgccgaatcgtgcgggggctgccccgtgccgcttcggcggacagtgcggaccgcgcggcgggtggtgcaacggctccggatgcgtcacagtcgtcggcggcctcctcaccggaggccggcggggcgggaggatctgtggcggtttccgcctcggtgcctgcttcgttgcccgttgcggcgggcggcccggccccggtggcggacggtggtgcggattcgggtccggcggctgtcctggcggacggtggtgctccgggtgcgggttcggacctggcgagcggtggggttgcggtgtctgcctcggcgggcacgggtgggacggaaggttccgccggcacggcgacgggatcgggtacggcgcaggccgggccggatgccggcagtgacggggaacggtcagacgagcgcggcgacgccgccggggaggaacagccgtgacaccgcggggtgccgaacggcccgacgacgacgccggacagggcggcaagaagggccgccgcttcgggcgtggccgtgccgaacagccggccgagccgatcgagatcccgcgcgaggagaccggctggctcgacgacctgcgcaccgccaagcagcagggcgaggcgatcggccccggcacgctgcccggtgaggcccggacgagcaagtccggtcgcagggcgcccgggccggacgagacgcccgacgacggcgggccggtcttcggcggcttcgacgtgggcgacgacacggacggtggcccggccgccggtgccgccgcacccggatggcaggccgcctccggtgaatacgcggccggtcggccgggtgggcaggggccgcagcagcccggcggacctcagggccggagggcgcaggcttttccgggtgggcatccgcagcagccggggggcggtcagccctatccgggtggcggggcgcagccgcagggtggaccgcagcagtatcagggtgggccgcagccccagggtggaccgcagcaggccggcggtcggccgccggtgggcgggcagatgcccggtgggcccgcggtcgtggcgggtgccgctgtcgccggtgtggtcgggccggggcagcagcctccggtgcggcgcaagggaccggtcgccgggcaggggccgggcgtggcgtcggtccacccggggtcgaacgcgtcggttccgcccggtcaacaccccggtgcgcccggtatgccgggtcaggctcctggcatgcctgggcagcgcggcggcccgatgcccggtgggcagcccgcgccgcagggccaggtgccgccgggtgggcgtcccgggcctcagggccaggtgccgcctggcgggcgtcccgggccgcaggggcagatgccgcttggcgggcgtcccgggccgcaggggcagatgccgcctggcgggccttccgggccgcaagggcagatgccgcctggcgtgtcgatgccgcagccgggtggtccggtgcccggtggccagcaggatactggtcgggctgggccgcatcagatgccgcctggccagatgccgtccggggcgatgccgccggctcgtcgcggcggtccgggagcgccggtgtctccgggggcgcggtccggtgggcccgttccgcccggtgcgcgggccggggtttcgccggagccgggtgccggtcggcggcaggtggatcccggtcagccgggattcccggcacaggcgggaccggcggggcaacccggatatcccgacccgtcggtgtcaccggcgataccgcgttccggtaacgctccggagatccccggtgtccaggccggggggccggatccgagaggcatgacttccggcgtacgcccggtctcgcccggcgtgcgaccgacctcgccggccgccccggcgcgtgaccggttccgtgcagcggcggccccggcgcccgtggacgttcagccgtccggcccgatcccgcccgccgtctatcagacggggccgattccgccggtcggtggcgggttcccgcccgacaccgtgccgccgagcgtctatcggaccgacacggtgccgccgagcgtctaccagaccggtccgattccggtcggtcccacgtccggtggccccggtgcggacgatcccggtggccgagcgcggggacggaaccggcgatcccgcgccgagagcggtccgaacgctccggccgaggtttacggcgcccggccggccgacggtttccagggccgccccggcagcggtgcacaggggccacaccatgcgccggacggcgtctacggtggcaccggcccgcagccggtctccggcgcgccggtccctcatgcggctcccgacagctcgacccctggcgctccgaacggcccgcgcggcggtgcggcgcggccgacctcaggctcgcacgctgccggtcccgacgggacgcgtggtggttcggcacgtccggtttcgggttcgcacgctgccggccccgaggggacctagctagctagctcgggttcccacgcggctgatcccgaggggatgcgtggtggttccgctcgtcccgtttccggtgcgcacgcgcagccggaggatcggttcggcctggctgccggtgccgcgggtggccccgccggccgccgtgcgggtcgtgcggccggtccggacccccgggaccatggcaccgggcgacacgaggcggcgggcacggccggttccgacccccgcgaccagcacctcggacggcatgaggcagccggtggacccggcatggccggcggaccgagggtgcccggtggaccggggggtgccggcggacccggaatgccgggcaggcccggggcggtcggtggacctgaggtgcctggcggacccggaatgccgggcaggcccagggccgccggtggacctggggcgcccaacggacccggaacgcccaacggcttcggaacgcccaacggacccggggtgcccaacggacccggggtgcccaacggacccggggtgcccgggggtgcccggcgggccgggagtggccgggggaccgggccggcccggagtggctggtgggtccggcacgcctgacggccccggggggcctggcgcggccggcatgcccggagccggtgtgcccgggccccggcggaccgggcccggagatgggcggccgattcgcgcggctgcggcggtgccgccgccggtggttccgggacggcagggaaagcgttctccggccatgcccggacgggccggcgcgatggcggaaagcacctccggagtcatccagccgcccgccccgcgcggcggcaacggtcagctgcagccggacgaggacggcttcaccaccgatcggcgcagccagaccggctcgatcatccccggccagggcagcgtttccgtgccgggtcagcccggcccggggcgtcgcggccgcggcgagccgcaggacgctcgcgtaacggccgacacctccgcgggcatgggctcgcccgaacggagccagggtttcccggcgggtgccggttcgcccgagcagagccagagtttcccggcgggcatgggctcgcccgaacggagccagggtttcccggcgggtgccggttcgccggagcggagtcagggttttccggcgggcatgggctcgccggagcggagtcagggtttcccggcgggcatgggtggtcctgagcagagtcagagcttccgtgccgggctgggtgggccggaacacgggcaagcgttccccggcggggctgggccggagtccagtcaggccttcccggccggtgccggtggaccggagccgacttcgcggggtcgtcgtcgccgggcggtgccggagcagggtgccggggacgggcgtggtccgaggcgagaccagggctccccggcaggccggcacggggccgagccggagtatgggcaggacttcccgggcgaggcgccgaccggtcgccacggacaggggcccgagcagagtcagggtttcccggccggtaccggtacgccgagcgggccggtctcgccggcgcccggaccgcgtggcggcggtccgcggcgcgggggcggcgctgcgacggcgggtgccgcggccgccggtgcgatcccgggactggaggggccgggtagcgcttcgacgcggattccgggcaacggcgcgccccggaatgttcccggtggtccgggtcgtggtgcggcaggcgtgcccggcaccggctccggcggtccaggtcgtggtgcggcgagtatgccgggtaacggtcccggtggtgtaacaggcgtacccggtggcggcccaggtggtccgggtcgtgctgcggcgggtgtaccgggcggcggcccgggtggtccggctagctagctagacggcgggcgtgccgggcagcgggcctggtggttccggcgggcccggcggcccgggggttccgaacggtcccggcggcgtgggtggtcccggcgatctccgcggcccgaacggtccgaccggaccgggtcgtggcgcggcaagcgtgccccggaacggcccgggcggcccgaaccggggcgcggcgtcggtcgctgtgccgggtcagggcgatccggtcgacctcgaggcgggtgcttcgagcggtctgcccgggcggggcgcggcttcggtgcccgggaacgggccggaggccggtggtccgagcggtctgccgccgcggggtgccgcgggtgtgcccgggaacgggcgcgagcccggtggtccgggtggtctgccgccgcgaggtgccgccggtgtgccggggaacggcgcggacgcgaccggttcgggcaacgccccgcggggagcggcctcggtcgcgatgcccgggaacgcgggtgcggccgctgtggcacagcggggtgcgggatcggcctcggtgccgggcggcgctccggtccccgcgacgggcaaggggacgggcaaggcttcggtcccaggccagggccggaacgacgggttcggtccggggagcggtgacgggttcggtccggggagcggcgacgggttcggtccggggagcggtgacgggttcggcccggggaacggcgacgggttcgggccggggagcggtgacgggttcgggccggggagcggcgacgggttcgggccggggagcggcgacgggttcgaaggcggggacgggtccgggagtggggacggggacggtttccgggacgagggtggcaagggcaccggcaccatcgcggttgcccgcgccgggagtgctgccggcgtaccgcgcaatcggaccggaatggacagcgggcccggcggcgaaccggagcgtggtctgtcggagcttcggcagaagctccggtcgcagcgccgcctgcggctgatcaccctgaccacgctggccgcggtcgtgttgctggtgctgcccgccttcttcgggatccgcgcggtcagcagcgacccggtcttcgcctcgctggacgcgctgaacgtgccgtcctgggccgatcagaagccggacgacaagaacagcggcagccgctggtgtttcggcgactgccggttccgggagcgcacgaccgaatcgcagcggccgttcaaggagacgaccgaggcctacagcaaggcgctgaccgaggccggttggtcgccgtggaaggtggccggctgcccggagtcgccgatcaaggccgaggagggcacctacacctgctggcggcgtgatgagttcactctggacctggcggtcggcctccccggttgcgcggtcgatcaggtggccgcggatgcgctgccggatgccgggaccgaccaggcggaggccgggacgaagggcgcgcagaagtgtgcggacggatcgacggtcagcatcaaggtgcgtgacgagatcaccgatgagcggggcaaggtggatcagcatccgggcccggtgggcgcaacgccggatccggttctgaaccagaacgatccgctcttgcagccgacaccgcaggcgtcgtgacgcgcgtggtggtcacggacggtagggtctgcacgttgtccccgccgattccgtgactgcccgaagaggagacgcgttacatgaacgccggagaaatcgcaggtctgatcgcggcgggcgccttcctgatgctcgtcgtcgtgctcgctttcccgctgctgaagctggggcgcacgatcgatgccgccacccggggcatcaatgaggtggtcgatcgcaccggtccgttgctcggcaacgtgaacaccaccgtggaaaatgtgaacaccgcgctcggccaggtccaggtctccctggacggggtgaacctgcagctggccaaggtcgacaccatgaccgagcacgtgcagaacatcaccgcgaatgtcgccaacctggtcaccgtggtctccgcggccgcggcgaatccgctggtcaaggtcgcctcgttcgggtacggcgtgcgtaaggccgcccgggcccgcagtgccgccgaggaggaccgtgaggtccgcaccgagatcaagcgccgtcgcaaagccacccgctgagccgcccggaaagaggaaatgctgccatgaaacgcctgctctggctgggtgtcggtctcgccgtcggcgcgctggtggtgcgcaagctcacgcgcaaggccgaggagttcaccccgaccgggatcgccacctcgctctcgcaatccgctggcgggctcgtcgagtcgctgcgtagcttcgtggaggacgtccgcgacggcatggccgagcgggaacagcagatccacgaggcgttcgccgaaggggttctgtacgaggacaagttcgccgagctgcgcgacgacacgcggcccggttcgcaggaggggaatcgatgaagacggcggaagtcaagcggcgcttcctggcgcatttcgaggctaacgggcacacggtggtcccgagtgccccgctgccggccatcgacgacccgaacctgctgttcatcaacgccggcatggtgcagttcgtgccgttcttcctgggtcagcgcaccccgccgtaccagcgggcggcgagcgtgcagaagtgcatccgcaccccggacatcgacgaggtcggcaagaccagccggcacggcacgttcttccagatgaacggcaacttctcgttcggcgactacttcaaggcgggcgcgatccccctcgcctgggagctgtcgacgaagccggtcgaccagggcgggttcggtctcgacccggagaagatctgggcgaccgtctacctcgacgacgacgaggcgatcgagatctggaagcagaccggtctgcccgccgagcggatcgtgcgccgcggcaacaaggacaacttctggtcgatgggcatccccggcccggccggcccgtgttccgagctgtactacgaccgtggcccggcgtacggcaaggagggcggcccggaggtcgacgaggaccggtacctggagttctggaacctggtcttcatgcagcacgagatcaccgacgtgcgctcgaaggagcagttcacgatcgtcggtgacctgcccaagcgcaacatcgacaccggcatgggcctggagcgcatcgcgtcgatcctgcagggtgtcgacaacctgtacgagatcgacgaggtccggccgatcctggcccgcgccgcggagatgaccggcaagaagtacggcgcgcactccgggcacgcggcgagcgagagccacccggacgacgtgcgcctgcgggtgatcgccgaccacgtgcggaccgcgctgatgctgatcggcgacggcatcgtgccgtcgaacgagggccgcgggtacgtgctgcgccggatcatgcgccgggcgatccggtcgatccggctgctcggctggcagggcccggcgttcaccgagctgctgccgatcgcgcgggactgcatgtcgccgtcgtacccggagctggccgaggagttcgggcggatctcgacgtacgcgtacgcggaggaggacgcgttcctctccacgctgaaggcgggcaccacgatcctggacaccgcgatcaccgagacgcgcgcggccaacaagacgcagctctccggtgaccaggcgttcaagctgcacgacacgtacggcttcccgatcgacctgaccctggagatcgcgcaggagcagggcctgcaggtcgaccaggacggtttccgccggctgatggccgagcagcggaaagcggcgaaggcggacgcggcggcgcgcaagaccgggcacgcggacctgtcggcgtaccggtcggcgctggacgccggcggcaccgtcgagttcaccggttaccaggagatctcccgcgagtcccgggtccgcgcgctgatcggcgccaagggccgggtcgaggtcgccggtgagggcgagaccatcgagctggtgctggacaccaccccgttctacgcggagggtggcggtcagcagtcggacaccggcctgatcaaggtcggcggcggtcaggtggaggtcttcgacgtccagcagccgattcccgggctgatcgtgcacaaggcgcgggtcgtgcagggtgaggtgcgcgccggtgagtccgggctcgccgagatcgacgtgacccgccgcaaggcgatctcccgctcgcacaccgcgacccacctggtccaccagacgatgcgcaacttcctcggcgagtcggccacccaggcgggatcgctgaacgcgccgggccgtctgcggttcgacttccacaccccgggcgcggtcaacccgtcggtgctcttcgacgtcgagcagcagatcaacgaggtgctgctgcgtgacctggaggtcaacgcgttcatcacctcgcaggaggaggcccgccggctcggtgcgatggcgctgttcggtgagaaatacggcgatgaggtacgggttgtcgaggtcggcgattacgcccgggagctctgtggcggcacgcacgtggcgcgttccggccagctcggcctggtgaagattctcaccgagtcgtcgatcggctcgggggtgcgccgggtcgaggcgctggtcggcatcgacgcgttcggcttcctggccaaggagcacctgctggtgtcccgcctggccgacctgttccgggtgcccggcgaccaggtcgccgaccgggtcgagcagaccgtcacggcgctgcgcgacgcggagaaggagctggagaagctgcgcgcgcagatggtgctggcgggtgcggccgggctggtcgaccaggcgaaggagctgcgcggggtggcgttcgtcggcaccgaggcgccggagggcgcgggcggcaacgacgtgcgcacgctggcccaggacatccgcggcaagttcgatccggcccgcccggcggtggtcgcggtgaccgcgcggtcaggtggcaaggcgacgctgatcgtggcgatcaacgcggcggcgaagggtcgcggcctgtccgccggcgagctggtcaagggcgcgctgtccggccggggtggcggcaacgccgacctggcgcagggcggcggcgttccggcggccgaggcgccgaacctgctcgccgcggtggagaaggcgctcgccgacgcgaactgagaataggttggtaatggatccgtcgcccagtgcgacggatcctttccttttccttgagaattcccggcgggactacaggtggccgttgtatcggcgggcggaacggttaagctttgcccgcgatcgggggtttttatcggcgtacgtcgatattgacccacggtggtcgaaggtagggttcgcaggacttggagacgcggttttgccggtgtgcggggagagagcgtgacgcacggcttcacccggggcgtgcgcctcggggtggacgtcggtcaggtgcgggtcggggtcgccaagtgcgatccggacggcatcctggccagcccggtcgtgaccgtggcgcgggaccagcaggccggcgaggacaagctccccaccgacctggcggagctggtcgcgctggtggaggaacacgaggccgtcgaggtcgtcgtgggtctgccggtggcgctcaacgggcgtgagggcgtggcggccggccacgtccgggcgtatgcgcagcggctcggtgcgctggtcgcgccgcggcccgtcgtgctctccgacgagcggatgtcgaccgtcgtggccagccgtaggctgagcgaacggggtgtccgcgggcgtcggcagcgggcggtcgtcgaccaggcggccgccgtggagatcctgcagggctggctggacgcgcagcggaggcagacttaattgagcgacaacgacctggatcccatgttcgagggagccgaggacccgggccggtggcggcatcgcaagaaggaacgcggccgcgggcgtacgatcatggccctcaccctggtgctcctgctgttcggtgcgctgggtggcgtcggctacatcggcttcggcaagatccgcagcttcttcacggtcgaggactacgacgggccgggcaccggtgaggccgtcgtcgaggtgaagtccggcaacaccgccaccgacatcgccaacaccctgttcaaggcgggtgtggtgaagagtgccgcggcgttcgtcgacgcggccaaggacgacccgaagagcaaggacatccaggtcggaacgtatctcctgaagaaggagatgaaggccaaggacgccctggccatgctgctcgacctgaagaacaagaacgtcaacaaggtcaccatcccggagggcctgatctcgctgcagatcttcgaccggctgtcgaagtcgaccggcatcccggtcgacgacttcaaggcggccgcgaagaacgtgcagaagctgggcgtgccgtcgatgtggttcaagcggcgcgacggcaagaaggtcgacccgtcgaagatcgagggcttcctctacccggcgacctacgagttccccaaggacgccaaggccgaggacattctcaagatcatcatcacgcacttcaacgacgagatgaccaagctcgacttcgccaaccaggcgtccaagctcaacatctcgccgtacgaggcgctggtcgccgcgtcgatcgcccaggtcgaggcgctgctgccgcaggacatgggcccggtcgcccgggtgctctacaaccgggcttacaccggcgagttcccgtgcagctgcatgcagctggacagcatggtcaactactacctgcggatcagcggcaaggacgccaaggcgtcggagaacctgctgcgcaaggagctgcacgacccgaagaacccgtacaactatgacgccaagggcctggcgatcacgccgatcagcagccccggcgaggtcgccctgaagggtgccgtcaccgccccgaagagcaattacttcttcttcgtgacgatcgacaaaaagggcacgatggcgtacgggcggaccaacgacgagcaccaggcgaacatccgaatcgcctgccagaacggtattccgatctgctgaggcggatcccggacacatcgacggccggtcggggttccaaccccgccggccgttgttgtggggtagcgccggaagtcgatccgtgacagccttcggctcgtagttccagccgggggcttgacaaagctggacatacagcggaggcggaaatgctcgacgatctggattcggtgctggcggaagaacagcagccacagccggacgcgccgcgccacaagcggggccggaccggccggtcggcgatcgcgttcttcctcagcctcgtcctgctcgccctgctggccggcggtggctggctggtctacagcaaggtgaaaggcttcttcgtcgccgacgactactccgggcccggcggcgccgagacgatcgtgcaggtgcagagcggccagtcggccacggacatcggcaacacgctgtaccaggccaaggtggtggcctcggcggaggcgttcgtcgacgccgccaaggacaacaaccgcagcaagaacatccaggccgggtggtacaggctcaaggtgcagatgaaggccgccgacgcgctgaccctgatgctcgacccgaagagccgctgggtcacccgggtcaccctgcccgagggcctgtcgtaccagcagaccttccagaagctgtcggaggccaccaagatcccggtggccgagttcaccaaggcggcgaaggacccggtcgcgctcggcgtcgacccgtcctggttcacccgcaccgacggcaagaaggccgacaagaccgacatcgagggcttcctgttcccgtcgacctacgagctgtcacccaaggccgacgccaccgacgtgctcaagacgatcatcgcgaacttcaacacccagatggaccagctggagttcgtctccacggtgcagaagacgcgcggcgggatcagtccgtaccaggcactgatcgtcgcctcgatcgcccaggccgaggcactcaaggacgaggacatgcccaaggtgtcccgggtcgtctacaaccgggcgtacggcgatttcgcctgccactgcctgggcctggacagcacggtcaactactggctgcggatcagcggcaagggctcgaaggcgtcggagaagctcaccaacgccgacctgcacgacccgaaggacccgtacaacacgcacgacaagccgggcctgccgcccgggccgatcggcaacccgggcctgggcgcgctcaagggcgcgatgagcccgaccgagaacttcccgtactactacttcatcagcgtcgacaccaagggcacgatggcgtacggcaagaccggcgacgaccacgagcgcaacaggcagctcgcctgtcacaacggcatcccgctgtgctgagcccggttccgtagaatacggccgtgcagaccaccagttcgcgccgcgcggccgtgctcggcaagccgatcgcccactcgctctccccggtgatccaccgcgccgggttcgccgcggccggcctgaccggctggacgtacgaggcgatcgagtgcgccgaggcggagctgcccggcctggtggccggcctcggcccggagtgggccggtctgtcgctgaccatgccgctcaaggagaccgcgctcaccctggccgcctcggccaccccggccgcgatcgccgccggcgtggccaacaccctgatccgtcaggacgacggcgggtggcatgccgacaacaccgacatccccggcatggtccgggtgctgcgcgcggccggcctgggcgccgggacgggccgacacgcggccaaggaggcgccgccccggatcaccgtcctcggcggcggcggtaccgcccgggccgccctggccgccgcggccgagctcggcgccgaggtggtcaccgtggtcacccgccgccccgaggcccgtgccgaactggagccggtggccggcgcgctcggcgtcaagctggacggggccccgtggtcggccgccgccctggacgccgacgcggtgatctccacggtgcccaagggcgccgccgacgcgctggccgccgaggtcacctggcgctccggcggcgtcttcttcgacgcgctgtacgacccgtggcccaccccgctggccgcctccgcgatcgccgcgggcgtcaccgtggtgtccgggctcgacctgctgctggcccaggcgctgagtcagttcgagcaattcaccggggtggccgaggccccggaggaggcgatgcgcgccgcgctcgacgaggcggcccgcaaccggtaggtgggaccggcgggccctctcgtcggatcggtccccgccgacactaggcttcttcccatgctgcgctggcttactgcaggtgaatcgcacggaccggcgctcgtcgccatgctcgagggtgtgcccgccgggatcgaggtgacgagcgccgacatcacccgtgacctcgtgcgccgccgcctgggctacgggcgtggcgcccggatgaagttcgagcaggacgaggtcgagttcatcggcggggtccggcacgggctgacgctgggcagcccggtcgcgatccgggtcggcaacaccgagtggcccaagtgggagacggtcatgtcggccgacccggtcgacccggacgtgctggccgcccagtcgcgcaacgccccgctgacccgcccgcgccccggccacgccgacctggccggcatgcagaagtacgggcacaccgacgcccggccgatcctggagcgggccagcgcccgggagaccgccgcccgggtcgccgtcggcgtcgtcgccaagcagctgatcaggcaggcgctcggcatcgagatcgtgtcgcatgtgatcgagctcggctcggtcgccgcgaagaccggcctgatccccaccctggacgacttcgaccggatcgacgccgacccgctgcgctgcctcgacccggaggccagcgcccggatggtggccgaggtcgacgcggccaagagggacgcggacacgctcggcggcatcgtcgaggtcctcgcctaccacgtcccaccgggcctcggctcacacgtgcagtgggaccgcaagctcgacgcccggctggccaccgccctgatgtcgatccagtcggtcaagggcgtcgagatcggcgacggcttcacccaggcccgctcccgcggctcggtcgcgcacgacgagatcgtcccgacggcggacggcgtccggcgggtcaccgaccgggccggcggcctggagggcggcatcaccaacggcgagccgctgcgcgtccgcgccgcgctgaagcccatctcgtccctgaaccgggcgctgcagaccatcgacatcaccaccggcgagccggccaccgcgatcaaccagcgctccgacgtctgcgcggtcccggccggcgcggtcgtcgccgaggcgatggtcgccctggtcctggccgaggcggccaccgagaagttcggcggcgactcggtcgccgagatccgccgcaacctcgcctcctaccgggacaacctggtggtccgctgatgcccccgcgcgcggtcctggtcggcccacccggcgccggcaagacgacgatcggcgaggcggtcgccgccaccctcggcctgtccttcaccgacaccgacacgatcatcgagcagcgggccggcaagccgatcccggacatcttcgtcgaggacggcgagcccaccttccgcaccctggaacgcacggtcgtcgccgagtcgttgtcctccttcgacggcatcctctccctgggcggcggcgccatcctggacgagaccacccgcgccctgctgaaggaccacacggtcgtcttcctctcggtggagctggcggacgccatcaaacgggtcggcctcggcgccggccgcccgctgctggcgatgaacccccgggcgacgatgaagttcctgctggaacagcggcggccgctctacaccgaggtcgccacccacacggtgctgaccgacggccgcgggcccgaggagatcgcccccgaggtcgccgccctcctgcgggcctagtccgcaacgtgtggtccgagccgccggctcatcacgtattcggtcacgccgggacggttggggtgtggttgacactcagccgtcctgcggaagccgtgacaccggtacagacgctcggccgccgcattgtcctccaccaacagacctgcctcggcccacgagccggtcatcgggcccgaggcggcgcagtgccggaagcatgtcatcgtcctttcgcgggttgccgtggacactatgagcgcggaaaaccggtgggcaatggatattcgtcgacgggggccgccggacggaaccgcccacctggcggaaccgcgccgagcacagcggacagaagcgcggctcgcggatagggtgacggccgtggtgacgcgaatcccggtgcatggtgaccgcccgtacgacgtgatcgtcggccgcggtctgcacgacgagcttcttccgatgatcgacggcgccgcgcgggtggcggtggttcatccggcggcgctgcgggagcgggccgaggcggtcgccaaggcagtcggtgggtgcacggtggtgccgatcgaggtgccggacgcggagaaggggaagaccgtcgaggtcgccgcccggtgctgggatgcgctgggtgccgccgggttcacccggaccgatgtggtggtcggggtcggcgggggtgccaccaccgatctggccggctatgtcgcggcggcctggctgcgcggggtgcggtgggtgccggtgtcgacctcggtcgccgggatggtcgacgccgcggtcggggggaagaccgcggtcaacatcgcggccggcaagaatctggtgggggcgttccacccgccggccggggtgatctgtgacctggacgcgctggacacgctgccggccgaggacatcgcggccgggctggccgaggtggtcaagggcgggttcatcgccgacccgcggatcctggagctgatcgaggcggatccggacgcggcgctggacccgcgcggcgaggtgctgcgggagctgatcgagcggaagatccgggtcaaggccgacgtggtcggggtggatctccaggagtccggactgcgggagatcctcaactatgggcacacgctggggcacgcgatcgagcgccgggagcggtacacctggaagcacgggcatgccgtggcggtgggcatgatcttcgcggccgagctggggcggctgtccgggcggctggacgacgcgaccgcggggcgccaccgggagatcctggtgcggctggggctgcccacgtcgtacgaccgccatgccttcggtgagctggaagccgggatgcgcgtcgacaagaagacgcgggccgccaccttgcgcttcgtggtgctggacggcctggcgaagccgggcatcctgaccgggccggacgacgacctgctgcggcgggcgtacgcggcggtggcgcgatgatctacgtgttgaacgggccgaacctgaaccggctgggcacccgggaaccggacatctacggcacgacgacgtatcaggacctggtcgacatgtgccggaccgtcgccgatgatctcggcagggagatcgccgtccggcagaccaacgccgagtacgagatgctcggctggctgcacgaggccgccgacgagggcgccgacgtggtgctcaacccgggcgcgtggacgcattacaacatcgcgatccgggacgcctgcgcgatgctgcgtggcaagctgatcgaggtgcacatctcgaacgtgcacacgcgtgaggagttccggcaccactcggtgatctcggcggtggcgaccggggtgatcgccgggctcggtatcgacgggtaccggctggctttggagcacatctgccggtagacccgattcgccctcaccagcgaatcgccggtaaagtggttcggtcaacgattcgagtcaagatcaaggcaggacatggcttccaccaacgacctgaagaacggcctggttctcaacctcgacaaggagctgtggtccgtcgttgagttccagcacgtcaagcccggtaagggtccggccttcgtgcgcaccacgctgaagcacgtgctctccggcaaggtcgtcgacaagaccttcaacgcgggcaccaaggtcgagacggcgaccgtggacaagcgcacgatgcagtatctgtaccaggacggcgacgactacgtcttcatggacctggacacctacgagcagatccacgtccccggcgccacggtcggtgacaacgcgaactacctgctgcccgaggcggaggccacggtcgcgctgcacgagggcgtcccgctctacatcgagctgccgaccagcgtcttcgtcgaggtcacctacaccgagccgggcctgcagggcgaccgctcgaccggtggcaccaagccggcgacgatcgagaccggcgccacggttcaggttccgctgttcatcaccaccggtgagaagatcaaggtcgacacccgcgacggccgctacctcggccgcagctgatggcggaaggtcccaagaaggaacggctggcgcgccgcaaggcgcgcaagcgggcgctggacgtccttttcgaggccgacatgcgcgatctgccgccgagccaggtgctggtcacctatctcgaccggatcgcgaagccgcaccccgagcacctggcgtacgcgatcaccctgatcgagggtgtcgccaagaacatcgaccgggtcgacgagctgatcgccagctacgccgagggctggacgatcgaccggatgccggtcgtcgaccgcaacctggcccggatcgccgtctacgagctgctcttcgagccggacgtggacgacccggtggcgatcaccgaggcggtggagctggcgcgggagatgtcgaccgacgacagcccgaggttcctcaacggtctgctggaccggatcgccgctttcgccacaaggtagaaaaaccgcaaaacggcctggaccgctcttcggtccgggccgttttcatgtttcgtacgtggtgagaacccgcgccgatcttggggggccgacgcgggctcggggtgagcgcgtcagctcgcgaagaacgcccgcgggtcggccaccaggacgccctgctcggtgagccgctcgatcaagccggacggcgagatgtcgtacacgatggcgagcgcgcgcaggtcgtcggcgcggatcgagaggacccggccgttgtagtcgccacgctgctgctggatcgcccgggcgtaccgcgccacgtaggcgaggtcctcaccggtggtgtcgtacagcttctcgaggtccagcacgatcttgttggtggcctcgaggcggatgccgctgccgtcgggcagcagctcggagacgggcacccggtagaagtcggccaactcggccaggcgcgagacggtcacggcacggtcgccacgctcgtacgagccgaccacgacggccttccagcggccgttggacttctcttcgacgccctgcagggacaggccctgctgctggcgaatggagcgcagacgagcgcccagtgacttcgcgtactcagacggcattcggacactcccagtactgtgctgtgccttcccggagggttcttcctcacggatcgctacgctgcgtgacggtacggagtttgcgagcgccggtcaagtgttggttaccgatgagtcgtgcgggccgcaaccaaagtcaccggcggtatccctacttgctcaatttgtccgttttgcgcgccgggtcaggcaggtcaccatgatcaaagcctgcgccactggtaacgtagcgtcagccagacatcctttaacgacccgtcccgtgaggcggggaaggaggtccgccgtggcacagccacgcgcagacgcgcccagcaagatcattttagccgggtccgacctgtcccgggtcgtcgaccggatcgcgcaccagatcctggagaagacgtccggcgccaccggcaccgtgcttctcggcatccccacccgcggcgtcccgctcgcgcaccgcctggccgcccggatccacgccttcgagggcgtcgaggtcccggtcggctcgctggacatcacgctctaccgcgacgacctgcgcctcaaggcgacgcgcgcactgggccgcaccgagctgccgcccggcggcatcgacggcctgcgggtgatcctggtcgacgacgtgctgttctccggccgctcggtgcgcgccgccctggacgccctcaaggacctcggccggcccagctcggtgcagctcgcggtgctggtcgaccgcggtcaccggcagttgccgatccgcgccgactacgtcggcaagaacatccccacggcgttgagcgagagcgtcaaggtcgctctcaccgaggtcgacgacgccgatgaggtacgcctgatcggagggctgcagtgatcaaacatctgcgttcggccgcggacctggacgccgcgaccgccaccctgatcctggacaccgccgccgagatggccgcgctctccggccgtgaggtcaagaagctgcccgcgctgcgcggccgcaccgtggtgaacctcttctacgaggactccacccggacccggatctcgttcgaggcggccgccaagcgcctctccgccgacgtgatcaacttttcggcgaagggatccagcgtctccaagggcgagagcctcaaggacaccgcgctgaccctgcaggcgatgggtgccgacgccgtggtgatccggcacgcggccagcggcgccccgcaccggctggcgaactgggtggagggctcggtggtcaacgccggcgacggcacccacgagcacccgacccaggcgctgctcgacgcgtacacgatgcgctcgcgcctgggccgcctcgacgggctgaacgtggcgatcgtcggcgacgtgctgcacagccgggtggcccgctccaacgtgctgctgctgaccacgctgggcgcaagagtcaccctggtcggcccgccgaccttgatcccggtcgacatcgcccctgccttgtccaaggagacccgagtctcgtacgacctggacagcgtcctgccggacagtgacgtggtgatgatgctgcgcgtgcagaccgagcggatgcaggactcgtatttcccgtccgcccgggagtacagccgccgctacggactggacatgacccggatgcgcaaactgccggagcacgcgatcgtgatgcaccccggcccgatgaaccgcgggatggagatcgcgcccgaggtggccgactcgccccgatccaccatcgtcgaacaggtcgccaacggcgtcagcgtccggatggccgtcctctacctgctcctgggaggcaagtgatggcgtacctgctcaagggcgtctcgattctcggcgccgcgccgacggatctcttcatcgacaacggcgtcatcgcggaacgcaccgcagaagcggacccggtggtcgtcgaggcggccggtctcgtcgccctgcccggtctcgtcgacgtgcacacccacctgcgcgaacccggccgcgaggacgccgagacggtggagaccggctcccgcgccgccgccctcggcggctacaccgcggtctgcgcgatggccaacacgtccccggtcgccgacaccgccggcgtcgtcgagcaggtctggcgcctgggccgggaggccggcctggtcgacgtccagccgatcggtgcggtcaccgtcggcctggccggcaagcagctggccgagctcggcgcgatggccacctcggcggccaccgtgcggatcttctccgacgacggcttctgcgtcgccgacccgaagctgatgcgccgcgccctggagtacgtgaaggcgttcgacggcgtgatcgcccagcacgccgaggaacaccggctcaccgagggcgcccagatgcacgagggcgaggtcagcacccggctcggcctgaccggctggccggcggtcgccgaggaggcgatcatcgcccgggacgtgctgctgaccgagcacgtcggcagccgcctgcacgtctgccacgtctcgacggccggctcggtcgaggtgctgcgccaggccaaggcccgcggcgtccgggtgaccgccgaggtcaccccgcaccacctgctgctcaccgacgagctcgcggcgggctacgacccggtcttcaaggtcaacccaccgctgcgtacggcgaaggacgtcaccgccctgcgccaggcgctgctggacggcgtgatcgacgtggtggccaccgaccacgccccgcacgccgtgcaggacaaggaatgtgagtggtcgtacgcccggccgggcatgctcggcctggagaccgccctgccgatcctgctgagcgtgttcggcgagcagtgggacctgatcgccgaccggatgtcggtcgccccggcccggatcgccgggctgagcgggcacggcggcgacctgaccgaaccgggcacaccggcgaacctgacgctggtggacccgtcggcgcgctgggtcgtggacccgggcgctctggcgagccgcagccggaacaccccgtacgcgggaatgaccctgccgggccgcatcgtggcgaccttcctgcggggcgaggcaaccgttctcgacgggaaggcagtcaagtgaccaaggcaatcctcgtactggaagatggccggtctttcaccggcaccgcatacggcgctgtgggggagaccttcggcgaggcggtcttcaccaccgggatgaccggttaccaggaggtgctgaccgacccgtcgttccaccggcaggtcgtggtgcagaccgcgccgcagatcggcaacaccggcgtcaacgacgaggacgacgagtcggaccggatctgggtcgccggatacgtggtccgcgacccggcccgccgcccgtccaactggcgcgcgaccggcgacctgggcgagcgcctggccgccgagggcgtggtcgggatcagcggcatcgacacccgcgccctgacccgccacctgcgcgagcgcggcgcgatgcgggtgggcatctcctcgctcgacctggacgtccaagccctgcgggaacgggtcaaggcccagccgcagatgctcggcgccgacctgtccgcccaggtcaccaccggcgagcgctacaccgtgccggccgagggcgagcaccggtacacggtcgccgcgctggacctggggatcaagcgcaacgtctcccgccggctggccgcccgcggcgtgaccacgcacatcttcccggcgaactcctcgatcgaggatctgctggcggtcagccccgacgcggtgttcttctcgcccggcccgggcgacccggccaccgccgacggcccggtcgcgctcgcccgggaggtgatgaaccgcgaggtgccgctgttcggcatctgcttcggcagccagatcctcggccgggcgctcggcttcggcacctacaagctcggctacggccaccgcggcatcaaccagccggtgctcgaccggaccaccggcaaggtggaggtgaccagccacaaccacggcttcgcggtcgacgctccgctcgacgaggtgctcaccaccgacttcggccgggtcgaggtctcgcacgtctgcctcaacgacaacgtggtcgaagggctgcgcggcatcgacgtgcccgcgttcaccgtccagtaccaccccgaggccgccgccggcccgcatgacgccgactacctgtttgatcggttcgtcgagctcgtcgagaagaagggctgaccactgatgccgaagcgtgaagatctcaagcatgtgatggtgatcggctccggtccgatcgtcatcggccaggcctgcgagttcgactactccggcacccaggcgtgccgggtgctgcgcgccgaggggctgcgcgtctcgctggtcaactcgaacccggccacgatcatgaccgacccggagttcgccgacgccacctacgtcgagccgatcacccccgagttcgtcgagctggtcatcgccaaggagcgcccggacgcgatcctgccgacgctgggcgggcagaccgcgctgaacaccgcgatcgccctgcacgagagcggcgtgctggacaagtacggcgtcgagctgatcggcgccaacgtcgaggccatccgcaagggtgaggaccggcagctgttcaaggacatcgtcgccaaggccggcggcgagaccccgcgctcgcgggtctgccactcgatggacgaggtgcgcgccacggtcgccgagatcggcctgccggtggtcatccgcccgtcgttcaccatgggcggcctcggctcgggcatggcgcacagcgacgccgacctggagatgatcgccggcgccggcctggccgcctccccggtgcacgaggtgctgatcgaggagagcgtgctcggctggaaggagtacgagctcgaactgatgcgcgaccggcacgacaacgtcgtggtcgtgtgttcgatcgagaacgtcgacccgatgggcgtgcacaccggcgacagcgtcaccgtggcgccggccctgaccctcaccgaccgggagtaccagaagctgcgcgacctgggcatcgcggtgctccgcgaggtcggcgtcgacaccggcggctgcaacatccagttcgcgatcaacccggacgacggccggatgatcgtgatcgagatgaacccgcgggtgtcccgctcctcggcgctggcctccaaggcgaccggcttcccgatcgcgaagatcgccgcgaagctggccatcggctacaccctggacgagatcccgaacgacatcacgctgcagaccccggccgccttcgagccggccctggactacgtggtcgtcaagatcccgcggttcgcgttcgagaagttcccgggcgcggacaaggagctcaccaccacgatgaagtcggtgggcgaggcgatgagcctgggccgcaacttcgccgaggcactgaacaaggcgatgcgctcgatggagacgtcgcaggcggggttctggacctacgctgacaagaccgacgatctgcaggaggttctggaggcgctgaagacgccgcacgacggccggctctacaccgtcgagcacgccttccggctgggcgcgaccgtcgagcaggtgcacgcggccagcggccggatcgacccgtggttcctcgacgagatcaaggcgctggtcgacctgcgcgccgagatcctggccgccccggtcctcgacgaggaactgctgcgcaaggccaagcggtccggcctgtccgaccggcagctcgccgcgctgcgcccggagctggccggcgaggacggggtccgcgcgctgcggcaccggctggggctgcgcccggtctacaagacggtggacacctgcgcggccgagttcgccgccaacacgccgtaccactactcgtcgtacgacgaggagaccgaggtcgcgccgagtgaccggcccaaggtgatcatcctgggctccgggccgaaccggatcgggcagggtatcgagttcgactactcgtgcgtgcacgccgtacaggcgctgcgcggggtcgatttcgaaaccgtcatggtcaactgcaacccggagacggtctccaccgactacgacaccgccgaccggctctacttcgagccgctcaccttcgaggacgtcctcgaggtgttccacgccgaggactcctccggcaaggcggccggcggccccggtgtgatcggcgtgatcgtccagctgggtggccagaccccgctcggcctggcgaaccggctcaaggcggccggcatcccgatcgtcggcacctcgcccgagtcgatcgatctggccgaggaccgcggcctgttcggcacgctgctcgccgagaacgggctgcgctcgcccgagcacggcaccgccacctcgttcgaggaggccaaggcgatcgccgacacgatcggctacccggtgctggtgcgcccgtcgtacgtgctgggcggccggggcatggagatcgtctacgacgagcccacgctgaagggctacatcgagcgggccaccgagatctccccggaccacccggtgctggtcgaccggttcctggacgacgccgtggagatcgacgtggacgcgctctgcgacgccaccggcgaggtctacctgggtggcgtgatggaacacatcgaggaggccggcatccactccggcgactcggcctgctcgctgccgccgatcaccctggccgcctcgcacctggccgaggtgcgccgctacaccgaggcgctggcccgcgggatcggcgtgcgcggcctgatgaacgtccagtacgccctcaaggacgagcagctctacgtcctggaggcgaacccgcgggcgtcgcgcaccgtgccgttcgtctccaaggcgaccggcgtgcagctggccaaggcggccgcccgggtcatgctcggcgccaccatcgccgagctgcgcgccgagggcatgctggtgcccgaccgcgacggcggctcggtgccggccggcgcgccgatcgcgatcaaggaggcggtgctgcccttcaagcggttccgcacgctcgccggcaacaacgtggacagcctgctcagcccggagatgaagtcgaccggtgaggtgatgggcatcgacgccgggttcggccaggcgttcgccaagtcgcaggccgcggcgtacgggtcgctgccgaccagtggcaagatcttcgtctcggtggcgaaccgggacaagcggtcgatgatcttcccggtcaagcggctcgccgacctcggcttcggcatcgtcaccacggccggcaccggtgaggtgctctcccggtacggcatcgactgcgagatcgtcccgaagcactacgagagcccgggcacgaacgccgtcgagctgatcctggccggtgagatcgccctgatcatcaacaccccgcagggctccggcgcgagcgcccgccaggacgggtacgagatccgcagcgccgcggtcaccgccgacatcccgtgcgtgaccacggtgccgggggcggccgccgcggtgatgggcatcgaggccctgatgcgcggcgacatgagcgtgcggccgctgcaggacctgcaccggctgctccggagcgacctctcatgaatctgttccgcaacgccgtccggccggtgctgttccggctgggcggcggcgacgccgagaccgcgcacgagtggacgctgcaccggctcgcctcgatgccgccggccgcccgtgaggtgatgcgccgccggtacgccttctccgccccggtggaggcgttcggcgtgcggttcccgaaccgggtcggcctggccgccgggatggacaagaacggcctggccctgccggcctggccggccctcggcttcggtttcgtcgaggtgggcacggtcaccgccaagccgcagccgggcaacgaccggccgcgcctgttccgcctgcgggagagcgaggcgatcatcaaccggatgggcttcaacaacgccggcgcggccgccctggccgcgcggctggaggagctcgggccgatcggtgtgccgctcggcgtctcgctgggcaagtccaaggtcaccccactggacgaggcggtcgaggactaccgggagtcgtaccggctgctgcacccgtacgccgactacatcgcggtgaacgtctcctcgccgaacacgccgggcctgcgcagcctccaggatcgcgacgcgatcaaggagatcctgaaagcgctcagcggtccggtcccggtgctcgtcaagatcgccccggatctgaccgagccggccatcgccgagcttctcgaggtctgcctggagcacggtgcggccggcctgatcgccaccaacaccaccctggcccgcgacggcctggccccgggcgatcggcacctggccgccgaggccggcgggctgtccggccggccgctgaccgagcgggcccgcgaggtggtccgcttcgtgcacgaggagaccggcggccggctgccgatcgtcggggtcggcgggatcctgtcggccgacgacgcctcccggatgctggatgccggggcgacgctggtgcagctctactccgggttcatctacaagggcccggatctggtcaaggcggtcgctcagggtgcccgcccggcccgcgcgacgacgccgcgatgagccccgtcgagcgcgagctgctggcgctcgaccgggcgcacgtgtggcacccgtacgggccgatgcccggccgcagcgatccgtatctggtggagagcgcggccggggtccggctgcgactggccgacgggcgcgagctcgtcgacgggatgtcctcctggtgggcggcggtccacgggtatcgccacccggtgctggacgcggcgctcgccgagcaggccgggcggatgagccacgtgatgttcggcgggctcacccacgagccggccatcacgctggcccgtacgctggtcgagctcaccccgcccggcctggagcacgtcttcctctgcgactccggctcggtcggggtcgaggtggcgatcaagatggcgatccaggccactggccgccgccggctcgccacctggcgcggcgggtatcacggcgacacgttccacccgatgagcgtgtgcgatccggacggcgggatgcactcgctgtggaccggggtgctgccggcgcagatcttcgccgccgcgccgcccgccgatttcgaccaggcctatgccgattccctgcgggacatgattgcggcgtacgccaccgatctggccgccgtgatcgtcgaaccggtggtgcagggcgccggcgggatgcgcttccaccatccggagtatctgcgcgtcctgcgcgaggccaccgccgagcacggcgtcctgctgatcttcgacgagatcgccaccgggttcggccgcaccgggcagttcttcgcggccgggcacgccggcgtgagcccggacatcatgtgcctgggcaaggcgctcaccgggggatacctgacgctcggcgcgacgctgtgcaccaccgcggtggccgaggcgatctcggcggggccgggcggcgcgctgatgcacgggccgaccttcatgggcaatccgctggcctgcgcggtggcgaacgcctcgctggggctgcttcgcgacggcgggtgggcggaccgcgtacgcgtgatcgaaaccggtcttaccgagggtctggagccgttgcgggacgcgcccggggtggccgacgtccgggtgctcggcgcgatcggcgtggtccagctggaccacgaggtcgacgtgccgcgggcgacggcggccgcggtggcccagggggtctggctgcgcccgttccgggacctgatctacacgatgccgccgtacgtcgccgacgaggccgacgtcgcccggatcaccgcgggcatcaccgcggcggcgctttctcacgagcagaggggtacacgctagatggaaaccttcggggaacgcctccacgccgcggtcgccgagcgcggcccactgtgtgtcggcatcgatccgcatgccgctctgctcgcccgctgggggctctccgacgatgtcgccggcctggaacgtttcgcccgtacggtggtcgacgcgctggccgatcgggtggcggtgctgaagccgcagtcggccttttttgagagatttgggtcacgcggcatcgcgattcttgagtcaactatccgacagtcccgggaggccggcgctcttgtcctgctcgatgtgaagcgcggcgacatcggctcgacgatggccgcgtacgccgccgcgtacctggatccagcgagtactctccgctctgacgcgattactgtgagtccctatctcggggtcggctcgctgcgcccggcattcgatctcgcgaccgccaccggcgccggaattttcgttctggcgctgacctccaacccggagggcgcttccgtccagcacgccgtcgcgccaggtgggagcactgtcgcgcaaaccgtgatcgacgagatttcccagctcaacgcgggtgtgagccctctcggaagtttcggcctggtggtcggcgcgacgatcggcgacaccgggcacgacctggccggcgtgaacgggccgctgctcgcgccgggcctcggagcgcagggcgcgacgcccgccgacctgcgtcgtgtcttcggcgaaagcctgcacaacgtgttgccgtcgtactcacgcgaagttctctccgcgggcccggagatcgccggtctgcgggccgccaccgaccgtgttctggacgactgccgcgccgcgctcgggtgattacacctgcgtagcgcggtgcgggccggggtaccccgacgttgccgaacgcgccgatgaccgctagttttcccggcgccgggaaccacatgcccctttggttccctggcacaccacgtttcacagatgcgccggtatggaactaccgccgcgatagggacctgaggagaactggtgccgctcccgtcactgagccccgagcagcgcgctgccgcgctggaaaaggccgcggaagttcgcaaggctcgggccgagctgaaggaacagctcaagtccggcaagaccaccctcgccgccgtgctcgaccgcgcggaggccgatgaggtcgtcggcaagctgaaggtctcggccgtgctgcaggcgctgccgggcatcggcaagatccgcgcgacccagatcatggagaagctgaagatcgccgagagccgccggctccggggtctcggcgaccagcagcgcaaggccctcctgggggagttcgctgcgaactgactcatcggctcgtgtaggaatgagccgtgagcatggatgacgacgcgcgcccggcagcccgcctcaccgttctttccggcccctccggggtcggcaaggacagtgtgatcgagctgatccgggcgcgctcgccttggatccggttgtcggtgtcggtcacgacacgcaagaaacgcgactacgagaccgacggcgagcactatcacttcgtgacccggtccgagttccagcggctgatcgacggcggacagctgctggagtgggcagaatttgcggggaacctctacggcaccccccgcgcgcaggtcgagggctggctccagcagggccggcccgtcctgttgaagatcgacctgcagggcgcccgccaggtgcgggccgccatgccggcggcccagctggtcttcctggccccaccgagcgtcgacgagctccagcgccggctgatcggccggggcaccgacgatccggagacgatcaagcgccgactggcgcacgccgacgaggagctcgccgccgagtccgagttcgacgtcaccgtggtgaacgacttcgtcgaacgggccgccgacgagctggtaggcttgctcggttcgttatatctagcccacgagcattaaggacttcaccacagtgggaactgtcgccaaccccgagggcatcaccaacccgccgatcgacgagttgctggacaagacctcgtcgaagtactcgctggtgatcttcgcggccaagcgcgcccgccaggtcaacgcctactacagccagctgggcgagggtctgctcgagtacgtcggtccgctggtcgagaccactccgcaggagaagccgctctccatcgcgatgcgggagatcaacgccggtctcctcaccgccgagccgaccgaccactaatcttgcgtctcatgcgatcccgtgtcccagctctgggcgcgggatcgcctgctatccgaggtggggcccggtgaccgaggtcgttctgggggtgtgcggcggcatcgccgcgtacaaggcgtgtgagctgctgcgcctgttcaccgagtcgggtcacggcgtgcgggtggtgcccaccgccgcggcgctgcagttcgtcggcgcgcccacctgggccgcgctctccggccgcccggtcgccacgcaggtgtgggacgacgcccacgaggtcccgcacgtgcggatcggccgggccgccgagctcgtcgtggtcgccccggccaccgccgacatcctggccaaggcggcccacgggatcgctgacgacctgctcaccaacaccctgctcacggccacctgcccggtcgtctacgcccccgccatgcacaccgagatgtgggacaatccggccacccgggccaacgtcgccacgctgcgctcgcgcggcgcgctggtcatcgagccggcggtgggccggctcaccggccgggacaccggcaaaggccggcttccggagccttcggccatcttcgagtacgcggtgtccgccctccgcggccgtcccgacctggcgggccgccacgtggtggtcaccgccggcggcacccgcgagccgctcgacccggtgcgcttcctgggcaaccggtcctccggcaagcaggggtacgcgctggcccgtgccgccctggcccgcggcgcgaaagtgacattgatcgcggccaacgtgacgctgcccgacccggccggtgccgatctggtgagggtgggcaccaccgaggagttgcgccgggccaccgtcgaggcggccggctcggcggacgtcgtggtgatggccgccgccccggccgatttccgcccggccaccgtggccgaccagaagatcaagaagaccgacgacggcctcccggccccgatcgccctggtgacgaacccggacatcgcggccgagctgggcgcggccaagcggcccgggcagttgttggtggcgttcgcggccgagacgcacgacgccctcgaacacgcccgggcgaaaatgatccgaaagcgggcagacctcatcgtggtcaacgaagtcggcgtcgaccgggtcttcggccaggaccgcaacacggtcactgtgctgggcacggacggtttcaccgaggcactcgacgagctctccaaagacgatgtggcgaataggattttcgaccacgtcgtggaccgcctggatgcccaggtcggcggcggtcggccgctctgactacacttccgcgttacctgtattcgacaactgaggagcaccgtggcacgccgcctgttcacttccgagtcggtcacggaaggccacccggacaagatcgctgaccagatcagcgacgggattctcgacgccctgctcgcgcaggacccgcgcagccgtgtcgcggtcgagaccctgatcaccaccggccaggtgcacgtagcgggcgaggtcaccacccaggcctacgccgacatccccagcatcgtgcgcgacaccatcctgcggatcggttacgactcgtcgaagaagggcttcgacggcgcgtcctgcggcgtgagcgtctccatcggctcgcagtccccggacatcgcccagggcgtcgacagcgccatcgagctgcgcgagggtgactccgagcacgtcctcgaccagcagggcgccggcgaccagggcatgatgttcggcttcgcctgctcggagacccccgagctgatgccgctgccgatcgccctggcccaccgcctggcccgccggctctcggtcgcccgcaaggacggcctgattccgtacctgcgcccggacggcaagacccaggtcaccatcgagtacgacgggctgcgcccggtccgcctcgacaccgtggtcgtctcctcgcagcacgccgcggacatctcgctggactccctgctcaccccggacgtccgcgagcacgtgatcaacccggagctggagggcctcggcctcgacaccgacggctaccgcctgctggtcaacccgaccggccgcttcgagatcggcggcccgatgggcgacgccggcctgaccggccgcaagatcatcgtggacacgtacggtggctacgcccgccacggtggcggcgccttctccggcaaggacccgtccaaggtcgaccgctccgcggcgtacgcgatgcgctgggtcgccaagaacgtggtcgccgccggcctcgccgagcgctgcgagacccaggtggcgtacgccatcggcaaggctcagccggtcagcctgttcgtcgagaccttcggcaccgagaacgtgccggtcgagcggatcgagaaggccatcaacgaggtcttcgacctgcgcccggccgcgatcatccgcgacctggacctgctgcgcccgatctaccagcagacggccgcctacggtcacttcgggcgggagctgcccgacctcaagtgggagagcaccgaccgcgcccaggacctgaagaacgccgcgtcctgaccacctgaagcgcaccggaaagccggcgctccccgcgtggggtgccggctttccctttgccgcttcccgagccgcctcggtttcgcacccttcaccaccttctggcgcgatgtcttttccggcacgggagcggacggggtgctcatgacgtacccccgcaatcgaccgggacgagcgcaaaccgcaaccggcgcccgcaaccgcgacagaagcgcacgccgccggcgaccaccgcgcccgcagtgcccgggcggccgcagcgctgatcgggagcgggtgtggcctggcggccaaccgtgcgcggagggcggcgttggggcggcggccgcagcggtgatccggagcgggtgtggccaggcgaccaaccgtgcgcggggggcggcgtcggggcggcggccgcagcggtgatcggcagcgggtgcggcctggcgggccccacccccgatgcccggcatcgagattccatccttcgacgccgcccccagcgttgatcttgtgaagaagttgtcggtgggtgcgggcagaatgttcggcgatggcgaccaagagtgtgcgagcggatcgggagccggcagagcacctgccggtcgcccgggtgtgcgtcgacgtccagctgccgcacctggaccgcccgttcgactacctgatctccagcgccgacgacgccgccgcccagcccggggtgcgggtcaaggtgcgtttcgccggccagctggtcggcggcttcctgctgtcccgggctgaggcctccgagcatcagggcaagctggcctacctggaaaaggtcgtctccgccgagcgggtcctcgaccccgaggtggcccgggccgcgcgggcggtcgcggaccgttacgcgggcagcctcgccgacgtgctgcgcctcgccgtccccccacgccacgcccgggtggagtcccagcccgtccccggaaacgccggcgccggccgatccctcggcgagggcgacgggtcggttccggagggcggccggtcggtttcggagggcggcggcgggtcagtttcggagggcggccggtcggtttcggagggcggcgggtcggtttcggagggcggcgggtcggtttcggagggcggcgggtcggttgccggaggcggcggcgagtcgtcggtccgggaggccggcccggccgcaggcgctcgcccgccggctcccgatctcccggagcccgcgcccggcggctgggattcctatccgaccggtcccgcctttctggccgcgctgcgggcggggcgtcccgcgcgcgcggtctggtcggcgctgcccggggaggagtggccgctgcggatcgccgaggccgcggccgcgaccgtgcgcggtgggcgtggcgtcgtcatcgtcgtcgccgacggccgggatctcgaccggatggaccgggcgctcaccaccgccctcggaccggaccggcatgtcgcgctgaatgccgcgctgggccccgccgagcggtatcggcggttcctggccgccagccggcatcaggttccggtggtcgtcggcacccgggccgccatgtgggcgccggccgccgacctggggctggtggtgatctgggacgacggcgacgatctgcatgccgagccgcggtcgccctacccgcatgcccgggaggtgctgctgacccgcgcgcaactggccgggtgtgccgccctggtcggcgggttcgcgcgtaccggggaggggcagttgctcctggagaccggatgggccagggagatcgtcgccgagcgcggggtgctgcggcggcggcagccggcgatctcgccgaccggggacgatccgcagctggcccgggacgccggtgcggtgaccgcccggctgcccagcgtggcgtggcaggcggccaagcaggccctgcaggccggggcgccggtgctggtccaggtgccgcgccggggctacctgccgtcggtggcctgcgccgagtgccgcaccccggcgcggtgcccggagtgctccggtccactggccctgcacgccgcccgggacgtgccgttctgccggtggtgcgggcggaatttcccggcctacgagtgcccggcgtgcggcgagcggcggctgcgcgcctcggtggtcggggccaagcggaccgcggaggagctggggcgggcgtttccgggtgtgccggtgcgcacgtccggccgcgacgagatcttgaacacggtgccgggcaccccggccgtggtggtggccactcccgggtcggagccggtggccgacggggggtacggcgcggtgctgctgctggactcctgggcgctgctgagccgggccgatctgcgggccgccgaggagaccatgcgccgctggctgaacgcgtcggcgctggcccggtccggctcggccggtggccgggtgatcgtggtggcggacggttcgctggcccccgtgcaggctctgctgcgctgggatccgggctggttcgccgcccgtgagctggccgaacgccgcgagctcggctttccgccggcggcccggatggcgtcggtgaccggtcccgccccggcggtggccgagctgctgagcatcgccgacctgccggacgggacggagcagctgggcccggtcccggcccgggaggagcaggagcggatgctgctgcgggtgtcccggtcccgggcggccgggctggcgcacgccctgcacgtggcggccggggtgcgcagcgcgcgcaaagcggcggtcccggtgcggatccaggtggacccggccgacctcttctgactccgtagactgtttccagccgttttcaagatttaggagttccgccgcgtgaccgtccagcccatccgtctcttcggcgacccggtgctgcgcactgcggccgacccggtcgtcgacttcgacaaggaactgcgcaagctggtcaaggatctgaccgacacgatgctcgacgagggcggcgccgggctggccgccccgcagctcggggtcgggctgcgcgtgttcaccttcgacgtggacgacgtggtcgggcacatcgtcaatccggtgctgtccttccctgacgaacaggagcaggacggtccggagggctgcctgtcgattccgggcgtctacatcgacaccaagcgccggcagaacgtggtggccaacggcttcaccgagtacggcgacccggtgcaggtggtcggcaccgggctgatggcgcgctgcgtgcagcacgagaccgaccacctggacggggtgctgttcctggaccggctggacgcggccgcccgcaaggacgcgatgaagcagatccgctccgcggagtggtacgacgcggccaagccgccgatgatcaaggagagcccgcacggccggggcatcttcggcgtggggcggtgagctgatgcgtctggtcttcgccggtacgccggaggtggcgctgcccagcctggaggcgatcgccgcgtccgggcacgagctgctggccgtggtcacccggccggacgccccggcgggccgcggccgtcgcctggtccgctcgccggccggcgcgtgggccgacgagcacggcatcgaggtgctcaccccggagcggccgcgcgagcccgagttccaggcccggctgcgggagctggcgcccgactgtgtgcccgtcgtggcgtacggcgcgctggttccgccctcggccctggagattccgaaacacggctggatgaacctgcacttctcgctgctgcccgcctggcggggcgcggcccccgtgcagcacgccgtcctgcacggcgacgaggtgaccggggcgagcgtcttcgagctggaggcggggctggacaccggcccggtctacggcaccgtcaccgaccagatccggttcaacgacacctccggtgacctgctgacccggctcgcgcacgagggcgccgggctgctggtcgcggtcctcgacgcgatcgggtcgggcaccgcccgggcgcatccgcagccgcgcgacggggtcagcctggcccccaaactgaccgccgacgacgcgcgggtccggtggaccgacccggcgttcgcggtcgaccggcggatccgggcgtgcacgccggcgccgggcgcgtggacgacgctacgcgacgaccggctgaagctgggcccggtccggccgatcgcgaacgcaccgcatctgcagccgggggagctgcgggtggagcgcacccaggtgctggccggcacggcgacgacgccggtgcagctgggtgaggtccgcgcggccggcaagaagccgatgccggccaccgactgggcgcgcggtctgcgtctcgaaccaggggagaagctggcatgagctcctccatcgcagcaactttaggagattccgcgtgacggaacatcgggcttcccgcccgcacggcgccggcccccgccggccggccgggcccggacacccgcgcgatcagcgcagcggccgggctccgcgggccgggcggccgccgtccgacccggcgcgccaggcggcctatgaggcggtcgccgccgtgcaccgcgacgacgcgtacgccaacctggtcctcggcgagatcctcggcggtatgggcctgcacgggcgggacgcggcgttcgccaccgagctgacctacggcacgctgcgcgccctcggcactctcgatctgatcatcgcctcggcggccggccgtgaggtcgcccggatcgacccgccggcccgcgacgcgctgcgcctcggggcgtatcagctgctctacacccgggtgccgacgcacgccgcggtcaaccagacggtcgacctggtgcgctcggtggcgcccggcgcgtccgggttcgccaacgcggtgatgcggacgatctccgagacgccgctggagacctggctggagcggctcgcgccgaactacgccgacgacccggtcgccaacctgtcggtgctgcaccaccatccgcagtggatcgtgcgggcgttcgccgaggcgctgggcggcgacctggaggagaccgcccggctgctgatcgaggacaaccagccgccggccgtgcacctgtgcgcgcgcccgggccgggccgacgcggtggagctggccgacgaggtcaacggtgtgccgggagccttctcgccgtacgcggtctatctcaacggtggcgctccgcgcgacctggccgccatccgtgagggccgtgcgcacgtgcaggacgagggctcgcaactggtcgcggcggcgctgctggccgccccggtcgagggccgggacacccgctggctggacctgtgcgccggcccgggcggcaagaccggcctgatcggcgcgatcgcggccggccggggcgccgaggtgaccgcggtcgaggtggccgagcaccgggcccggctggtcgagcaggccaccgaggggatgccggtgacggtcttcccgatggacgggcggtccgtgggccgtgatccggacctgccggaggaggcgttcgaccgggtgctggtcgacgcgccgtgcaccggcctggggtcgttgcgccgccgccccgagtcgcgctggcgccgccagccggccgacctgccgccgctcacccggctgcagcgggagctgctggtggccgcgctgcgcgcggttcgcccgggcggcgtggtcgcctacgtgacgtgctccccgcacatggtggagacccaggtgacggtcagcgagggggcccggcgcagcggcgtcgaggtggacttcgtcgacgcccggccgctgctgccgccgggcatgccgggtctgggcgccgggccgacggtgcagttgtggccgcaccggcacggcaccgacgcgatgttcctggcggtcctgcgccgcaccgcctgagggttgtccacagggccggggacggctcggcgcgaagtcatacactgcatcggtgacgtcatcgccgatcatcgcgccgagcatcctcgcctccgacttctcccgcctcgccgaggaagtgcacgccatcgagggggcggccgactgggcgcacgtggatgtcatggacaaccacttcgtgccgaacctgacgatcggcctgccggtggtccaggggctgcgcaaggcgacgacgatcccgttcgacgtgcacctgatgatcaccgacccggagcgctgggcccccggctacgccgaggccggggcctacaacgtgacgttccacgccgaggcctgcgacgacccggtcggcctggccaagacgctgcgcgcggccggcgccaaggccggcctggccatcgaccgggacaccccggtggagccctacctggagctcctgccccatctggacaccgtcctgatcatgacgatcaaggccggcttcggcgggcagaaattccttcccgagatgctcgacaaggtgcgtgacgtccggcgccgcgtctcccggggcaacctggacgtgcgcatcgaggtggacggcgggatcgcggccgacaccatcgagcaggccgccgaggccggcgccgacgcgttcgtggcgggcaccgccgtctatggggctgccgatcccgccgaggcggtgcgtaagcttcgggcactggccgccgatcgcatggggatctcgaggtgagtaccgctgagccggggcccgtggtcgacgacttcgggctcgacgatgaagagcagcgacccgatctcatcctggtcgtcgacgacgaccaggacatcgcgagtttcgtcgagttcaacctccggatgcagggcttcgaggtgatccgcgcgcgcgacgggcaggaagcgctcgacctgatggagacgcaccgtcccgacctggcgatcgtcgactggatgatgccccggatggacggtgtcgagctgatccgcgcgctgcgcgccgacccgctcacctcggccctgccggtgatcatgctgaccgcccgcagcatgacggtggacaaggtggtcggcctgaccaccggcgccgacgactacctgaccaagccgttcgacaccgccgagctgatcgcccgggtctccaccacgctgcgccgcaacaaggagttccgcgaggtctccccgctgaccggcctgcccggcaacgcccgggtccgccgcgagatcatcgaccggatgcgggccggcggcgactactcggtcggctacatcgacgtcgatcgcttcaagagcgtcaacgacgtgtacggtttcgaccgcggcgacgagttcatcaccgccctggcgcgcagtctgcagcgggccagcgccgccaccggcaagccgtcgatcttcctgggtcacatcggcggcgacgacttcgtcttcatctgccaccccgaccaggtgctccccctgacgaagaacatggtgaccgacttcgagtccgccgccgaccgtctctacgacccgagggacgcccagcgcggctacatcgaggtccccgaccgccgcggcaacaagcaccgcgccgcgctggtcaccctgtcgatcggcgtcgcgcaggccacatcgggcggccgccagttcgctgacccgcggatggtgatcgcggtcgcctcggagatgaagaaggtggcgaagtcccagccgggctcgtatgtcgcgatcgaccgccgccgctccgacgccgaggactgagcttctccgccggttgcgtccaccggttgtcggggcctcgccggtagccgggacgagccatggtgtgcagggtggccgaccgcgcccgggccggctgggctgatcacgcacgtcgtcgcggacgcctaagggcggatctcaccatgggctgtaccacaaccccctggatctcagcggcgtgccggggcgtatgtggggacgtattcctggccggtcagggattggatggcggcgatgacccggtcggtgaggcggcgggcatcgcgggccgagttgacccggatttcgatggcggggccgaaggtcagggtgatcggctgcggacgcgggaggtggcggccggtggggcggatgcggtcggtgccgaggatgccgaccgggacgatggggacgccggcctggccggccaggcggacggcgccggtgcggccgcggtagaggcggccgtcgggggagcgggtgccctccgggaagacggcgaccaggccgccggccttgagaatcgggatggcggcgtcgaaggcggtcaggaccgcgcggccgccggcgcgttcgaccggaatggcgcccatgccggtgaccacgtggcgggtgagcgggttgccgcggaagtattcggctttggcccagaaggcgatgtgccggggggtggtgacgccgaggaagatctggtcggcgatggcgtggtggttggcgcagaggatcgcgccggaggatggcagattttccaggccggtgacggtggtcggccacaggccgcgcaggagcaggccgaggctgccgcgggcggcgcggtagaggggcggcattccgggtttcgaacggttgcggggcggcgttgcgggcatcaagcgccttccgtggtgcgacgtgggcctagatgtgcggtgaggatggcgtcgatcaccgaggcgggatcggtttcgccggtggccagggtgagcgagccccagttcgagagctcggccaggccgtgcagggcggaccagagggcggccgcggtgatctcggcgggtgggtccggggtggggtggaccgcggtgaccagctccaccagaagggtgaacagggggagcgcggcgtgccgcaggcccagctcgccgccactctgcagcaggtcgtggcggaacatcaggtcgaacatggcgcgatcggtggcggcgaaacgaacgtacaacctcgccagtgtggccaaccggcggcgcggatccggaccggccgcctcgagtgccgcctgcacctgggttttcaggtcggcgaagccgacgtgggcgatcgcggacagcagcgacaggtgggtggggaagtagcggcgcggtgcgccgtgcgagacgccggcgcggcgggctatctcacgcagtgagagggtgcctggaccttccgtgcgcaacaactccgcgccgactcggaccaggcggtcgcgtaaggcgtcgtcagcgggcatagacagtgtctaccagagtgagtagacactgtctacgacaggtgcgggcgggcggcggttctgacaatctgccggtatggacgtcgacgcactccgggccggcactccgggctgccgccaccggattcatctgaacaacgcgggcgccgcgctgatgtcgcaggcgacgctggacaccgtggtcgcacacctgcggctggaggccgagatcggcgggtacgaggcggccggcgcggtcgccgaccgggtcgccgcggtctacgccggtctcgccgagctgctcggcgggcgggccgacgagatcgcgctgttcgacaatgcgacgcacgcctggcaggcggcgttccacgcggtgccgctgaaggccggcgaccgggtgctgaccgggcgcaacgagtacggcagcaacgtgctgggctacctgcaggcggcccggcgggtcggcgccgagatcgtcgtggtgccgaacgacgagcacgggcagatcgacacggtcgcgctcgccgggctgatcgacgagcgggcgaaagtgatcggcctgacccacgtgccgacggccggtggtctggtcaatccggccgccgaggtggggcggatcgcacgggccgcgggggtgccctatctgctggacgcgacgcagtcggtgggccagttcccggtcgacgtcaccgagatcggatgcgacttcctgtgcggtacggggcgcaaattcctgcgcgggccgcgcggcaccgggttcctctgggtccgcgacggcatccttgagcagctcgaaccgcacgtggtggagatccagtcggcggactgggacggcgcgcggggcttcggctgggtgcccggggcgcagcggttcgccacctgggagctgaactacgcggcggtgctcggtctgggcgcggcggtcgaccaggcgctcaatctggggctcggcgagatcggcaagcgcaacgcggagctcggcgaccggatgcgcgggctgctggaggacactcccggcgtgaccgtttatgacctcggtcgcgagcggtgcgcgatcgtcaccgcggaggtggccggggtgggcgccgagcaggtggtggcgcggctcgccgagtccggggtgaacgtgacctcgaccgtgccggcgcaccagcagttcgacaccgaggaccgcgatccgccgccgctggtccgcttctcgccgcactactacaacaccgaggacgaggtcgagcacgcggcgaccctggtcagcgccatggtcaccaagccgttgtgagatccacgacgcacggggtggcaaattcgccaagccgtgcaagactcggggataacccaccacgcgctggcgggactcggtgaaattccgaaccggcggtgatccgttgcctttggcggcggtaagcccgcgacccggacgtccgcaccacggacggccggtggacctggtgagactccggggccgacggttgatcgggcgcaggctcggtcagacagtccggatgggagacagcgcgcggaatcggacgggtgtgccctgacacggggtgcactcgggtcggggcccccgcagggccgtggcctcgccggggtacgcgaagcgtaccccgaagtgtctggttcttggcgttttctcccttcgctcgtcgcgcgtgacaaggccgcgcgacgaccatcgcgcgcacgacaccgcgcgagcccttcgcgcggccgaggatgtcgcgcgagcccttcgcgcggccgaggatgtcgcgcgagcctttcgcgcggccgaggatgtcgcgcgagcctttcgcgcggccgacgacaccgcgcgagcccttcgcgcggccgaggatgtcgcgcgagcctttcgcgcgacggatgacggtgcgcgagcccctcgcgcggccgatgagagcgcgggaggacgggcgcgatggtgaccgaggacgaggcgatgcgccgcgcgattgcgctggccgcccggggcctcggcacgaccagccccaacccggtggtcggctgcctgctgctcgacgccgccggcgaggtggtcggcgagggcttccacgcgtacgccggcggcccgcacgccgagatcgtcgcgctggcccaggccggcgagcgggcccgcggcggcacctgcgtggtgaccctggagccgtgcaaccacaccggccgcaccggcccgtgctcggacgcgctgctgcaggccggcctgcgccgcgtggtgatcgccgtcgacgatccgaacccggtcgcctcggggggcgccgccaccctgcgcgcggccggtgtccaggtggagaccggggtccgccgcgccgaggcggagctcggcaatctcgcctggctgaccgcggtgcgccgcggccggccgttcgtcacctggaagttcgccgccaccctggacgggcgctcggccgccgccgacggcaccagccagtgggtgagttccgccgagtcccggttcgacgtgcacctgctgcgcagcaccgtcgacgcgatcgtggccggggtcggcaccgtgctcgccgacgacccgcagctgaccgtccgcgatctgcgggacggctcgctcgccatcagacagccgctgcgcgtcgtcgtcgactcgcaccggcgaacgccggagaacgcccgggtccgggacgcggcggcacccacctggatcgtcaccgccgacgaggtcggcgccgggccggacggccgcgtcgacctgaccgccgtgctcaccggcctgtacgaccgcggcatccgcaacgtgctgctggagggcggcccgacactggccggcgcgttcctggcggccggtctggtcgaccgggtgatcggctacgtcgcgccgaaactgctcggcgccggccgggccgccctggtcgacgccggcgtcggcaccatcgccgacgcgctcgaactggacttcaccgacatcgcgcagatcgggggcgacctgcgcttcaccgccacgctccgccacaaggagaactgacgcttatgttcactggcatcgtcgaagaactgggcgagatcgtccggctcaccgagggctccgaagactcggcggtcatcgccgtacgcggcccactggtcacctcggacgcccgcgacggcgactcgatcgcggtcaacggcgtctgtctcaccgtgatcgacaacgtcgacggggtgttcaccgccgacgtgatgggcgagacgctgcgccgctcgtcgctgggcgcgctcaaggtcggcagcagcgtgaacctggagcgggccgccgcgctcggcagccgcctcggcggtcacctggtgcaggggcacgtggacggcgtggcgactctgcagagccgggagcctgccgatcagtgggaggtggtcaccttctcgctccccgccgagctggcgaaatacgtggtcgagaagggctcgatcacggtggacggggtgtcgctgaccgtcatggcggtcaccggcgacacgttctcggtcgggatgatcccggccacctccaagaacaccgtgctgggcagcaaagccatcggcgaaccggtcaacctcgaggtcgacgtgatcgccaagtacgtcgagaagatgctggggagccgcaatgtctgagagcatcgagcgcgcgatcgccgagatcagggccggccggccggtgatcgtggtggacgacgaggaccgggagaacgagggcgacctcatcttcgcggccgagcatgccaccccggagctggtcgcgttcatggtccgctacacctccgggtacatctgcgtggcgatcaccgagtcggacgccgaccggctggagctgccgccgatgtaccacaccaaccaggacaagaagggtacggcgtacgcggtggccgtcgacgcccggcacggcgtcagcaccggcatctcggccgccgaccgggcccgtacgatcagcctgctcggggcggcgagcaccgagccgtccgacctctcccggcccggccacgtcgtcccgctgcgggccaaggcgggcggcgtgctgcgccggccggggcacaccgaggcgtcgatcgacctggccgtgctggccggctgcaccccggccggcgcgctctgcgagatggtcaacgacgacggcaccatgcagcggatgcccgacctggagaagttcgcggccgagcacgacctggtcctggtcaccatcgccgacctggtcgcctacctgcgggagcgggcggaccggaagatcgagcgggtggtcgagacggtgctgccgaccgagcacggcgtgttcaccgcggtcggctaccgcacccaggcggacaacggcgagcacgtggcgctggtctacggcgacctgtccgacggtgaggacgtgctggtccgggtgcactccgagtgcctgaccggggacgtgttcggctcccggcgctgcgactgcggcccgcagctggacgccgccctggagcgggtggcggcggccgggcgcggggtggtcctctacatgcgcgggcacgagggccggggcatcgggctgttgcacaagctgcaggcgtaccagctgcaggaccgcggtttcgacacggtcgacgcgaacctggagctcggtctgccggccgatgcccgggactacggcacgggcgcgcagatcctgtgcgacctgggcgtgcgatcgatgcgcctgctcaccaacaacccggccaagcgggccggcctggagggctacggcctgcgggtcatcggccgcgaggaactgccggtccggctgcacccggagaacgtgcggtacctgcgcaccaagcgggaccggatgggccacctgttcgaggcgttgggctgaccgcggccgtgaacggggcgatgatgacgaaaaagggggactgagatggccggcttcggtgatccgcacatgcagaccgtcgacgcggccgggctgcggctcggcatcgtcggctcgcgctggcacaacgacctggtcgaccacatgatcgaccgggcccggtcggccgccgaggcctgcggggtgaccgaggtgatcgtgacccgggtggccggctcggtggagctgccggtcgtcgcgcaggcactggccaagcgctgcgacgcggtggtcgccctcggggtggtgatcaagggcgagacccagcatttcgagtacgtctgtgacgccgtcacggccgggctgacccgggtggccctggacgagcagaccccggtggcacacggtgtgctgaccgtgcacagcctcgggcaggcccgcgaccgggccgggctggaggactcgatcgaggacaaggggtggcagagcacggtggccgtcctggacgccgcgctcgccatccgcgaggtggagaagttctgaccggctagagccgaccggcttcgatgatccgggccaggaactgcctggtccgtgcctcgacggggtcgccgagcacctgctccggcggcccctgttcgaggacccggccggcgtccaggaaggccacccgatcggcgacctgcttggcgaaacccatctcatgggtggccaggaccatggtcatgccctcgcccttgaggtcacggatcatggtgagcacctcgccgaccagttccgggtcgagcgccgaggtgacctcgtcgagcagcagcagccgcgggctgttgaccagggcccggacgatcgccacccgctgctgctggccgccggagagccggtccggataactgcccgccttgtcggccagcccgacccgctccagccactccagtgcctgggcccgggcctcggcggccggccggccgtgcacccgggtcggggccagggtgatgttctgcagcacggtcatgtgcgggaacaggttgaacgactggaacaccagcccgatcctgcggcgcaccaggtccgggtcgatccgcgggtcggtgatctcctcgccgtccaggccgatcgtgccgtcgtcgatctcggtgagcaggttgacgcagcgcagcagcgtcgacttgcccgagccggaggcgccgatcagggccaccacctcgtgctcgccgacgtccaggctgaggtcgtcgaggacggtccgcccgtcgaacaccttgcgcacgtttctgcaggagagcaccacgtcaggaccccgcgttctggcggcgggcggcgcgcagcgtcacccagtcggtgaccgcgatcagcggcagggcgagcaggacgaagagcaccccggccacgacgtacggggtgaagttggccgactcggcggtgccgatctgggcggcccggatcgcgtcgatcggcccggccagcgagatcagcccgacgtccttctgcagcgcgacgatgtcgttgagcagcggcggggtgacccggcggaccgcctgcgggagcaccacgtgccgcatcgtccggcgatagccgagccccagcgagcgggccgcggcgacctggctggggtgcaccgactcgatgccggcccggaacacctcggccaggtacgccccgtaggtgacgatgatcgctgcggcgcccagcaccagcacgtccggcgtgccgcgcaggcgcaggccggggatgccgaacgcgaacaggtacagcacgatgatcagcggcaggccgcggagcgcgtacgtatatccggtggccagggcgcgcaccgggaagaacaccgcaccgcgggtggtccgcaggatcgcgatcagcagccccagcagcagtgcgaggaccgcgcacaccgagagcagcttcaggttgagccagagcccggtcaggatgtccggcaggtacttgcgggccacctcggggtcgaagaacgactgcttgacccggggccagccgggcgagccggtgatcgcgacgccgagcagcgtcccggccacggcggtggagagggcggcgagcaggaccgagcggatcgcctgccggcgacggtaggcgaaccgctcacgctgccgctgactcggtgcgtaggtcactggagttcgggcgctccgccgtcggagagccaggtcttctccagcaccgcgagggtgccgtcctggcgcagctggtcgaccaccttgctgacgcagccggtcagcttggatcccttgtcgagcaccaggccgaactgctcgggcacgccgacctgcgggagctggccgatgatgacgccgtccttgagctcggcgccggtcatgtagaacgcggtcggcaggtccaccacgatgccgtcgacggtgccgttgaccagcgccgccttggcgtcgtcgttgctgttgaagaccgacggcttggcggtcggcttgatcacgtcggtgatcgcctggtagctggtggtgcccacctgggcacccagcttggcgccggccaggtcggccagggacttggcgcccgcgatcttcgacttcttcgtcgtgatcacggtctgccgcacgaggtagtacggcgaggagaagtcgaccgcctgccggcgctcgtcggtgatggagaactggttgatgtcgaagtcgaacttcttgggcccgggcgcgatcgcgttggtgaacgtcaccgacgtccacgcgacctgatccttggagtacccgagccgctcggcgacctggtaggcgaccgcggactcgaagccctgcccgttggccggcttgttgtccttgtaccacggctcgtaggccggggtgtcggtgccgatcgtgagtttgccggacgcgaccgtggcgagcgcgcccgagcggcacgggtcggcgaccgacgaggagggggatgcggtggacgtggtgtcgtcatcgaccggggaacaggccgtgacggcggcgagcgccagcacggcgccgcccatgaggaggggggtgaaacggctgaccatgccgggcagcttagaagacgtcccacacgctgggggcgttcgtcgtcagaccgtaatgagctgcaacaatcgtctcccgtgaagacgttcgaagaactgttcgccgagttgcagcgcaaggcggcggagcagacccccggttcgggcacggtcgccgcgctcgaacgcggagtccacttcatcgggaagaaggtcgtcgaggaggcggccgagtcctggatggccgccgagcacgagggcaaggaccggaccgcggaggagctttcgcagctgttctaccaggcacaagtcctgatgatcgccagtggtctcaccctcgaggacgtgtaccgacatctctgacgtgcgccccgatccgtccgaagtcgaacgaaggagcacgtcaatgctgcgcatcgccattccgaacaaggggaccctgtccgcgccggccagccagatgctgagggacgcgggctaccgtcagcgcaccgacccgaaggacctcgtctgccgtgacgaggccaacaatgtcgagttcttctacctgcggccgcgcgacatcgcgacctacgtcggctcgggtgacctggatctcggcatcaccggccgggatctgctcgtcgactccggcgtgccggccaccgagctgctcgacctgaacttcggcggcgccacgttccgctgggccgccccggccggcacgctgacctcggtggaccagatcggcggcaagcggatcgccaccgccttccccggcctggtcggcgcctacctggtcgagcacgagctgaaggccgaggtggtccgcctggacggcgcggtcgagaacgcggtccggctcggggtcgccgacctgatcgccgacgtggtggagaccggcgccacactgcgccaggccggcctggtcacgctcggcgagccgctgatccgctcgtcggccgtgctgatcggccgcgacgtccaggccccggccggcgccgcgcagctgctgcgccggctcaacggcgtgctggtcgcccgcaacttcgtgatgctcgcctacgacgtgcgggccgacctgctggagcaggccaccggcctgaccccggggatcgagtcgccgaccgtctccccgctgcaccgggagggctgggtcgccgtgcaggcgatggtccagcgcagccaggtgcaccgggtgatggatgagctgtacgacctcggcgcacgtgccattctggtgaccgacatcgccaactgcaggttgtgatcatgactgacgtggttttccggccgagaaggatccgctgggtggccggcccgatcgcggccgccgtcgcgatcttcttcaccgtgctcagcttcggtctgcacggccagggtggtttcgaccactccgggcaggtcggggtgggcagcttccagcgcggcgaccaggtcgcgatgatcgggctgggcatcctgctcgggctcggcatcctgaccttctgccggccccgggtggccgccgacgagcagggcgtgcacgtgcgcaacgtggtgggcggttacgacctgccgtgggacgtggtgcgcgcggtccggttcgaccggaactcgccgtgggcgcagctggagctcttcgacgacgagcaggtgtcgatccacgcgctgcaggcggtggacaaggactacgcggtggacggggtgcgcgcgctgcgggccctgcattcggcctctcacaaggcctgatagactagcgggcagtcgaccacgtccggggcctgcctcggacgcgaaagaggagcccgctggttcccacccgagtcactgacgtggctgggtccggtcatccgaacagggaataatccctgcgcggggcgcgtcctccctttggacgtcgatgaccggtcgagcgggcctcggcatgcgcgcctgatccagctggatcaggagatgcgcgcgccgaggtcttctgctttcccggccgtcccggcttgtcagcggggcggtgattcggggccgaccgacattggcagaagtaggtacgttctgaggaggccccatcagcgtcgaaccacgcgtgaacgaacagatccgggctcgagaggtccgtctggtcggtccggagggtgagcaggtcggcatcgtgccggtcgagcgtgcgctccaactggccgcggatgtcgatctggacctggtcgaggttgctccgatggcccggccgccggtgtgcaagctcatggacttcggcaagttcaagtacgagagcgcactgaaggcccgcgaagcgcggcgcaaccagcagcagaccgtcatcaaggaaatgaagcttcggccgaagatcgacccgcacgactacgagaccaaaaagggtcacgtggtgcggttcctcaaggcgggcgacaaggtcaaggtgacgatcatgttccgcggtcgtgagcagagccggcccgaactgggcttccggctgctccgtcggctcagcgaggagatctccgagctgggcttcgtggaggccagtccgaagcaggacggtcgaaacatgatcatggtgctggcaccgcaccgggccaccaaggccgcggcggtcgccgccaccgcggccggagtcaagcctgcccgtgagccgcgcgaggacgacggcaccgaggttccgtcggccgagactgccgacagcacagcagcagcagagtagtcagcttttccgccggtcccccgggctcggcggaaagatcagaaagaggcgttctaagtgccgaagatgaagagccacaccggcatgggtaagcgggtgaaggtcaccggcaagggcaagatcgtgcgtgagctgaccggcaagcgccacctgctcgagcacaagtcctcccacgttacccgccggatgaccggcactgtcgtggtggcgaaggtcgacgtcccgcgagtgaagaagcttctgggccgctgacgcgcgcctgacacgttcccctgtaaggagtacttgaaatggcacgcgtcaagcgggcggtaaacgcccagaagaagcgccgcaccctgctcgagaccgcgagcggctaccgcggtcagcgctcccgcctgtaccgcaaggccaaggagcaggtgctgcactcgatgcagtactcgtaccgtgaccgccgtgaccgcaagggcgacttccgccagctgtggatcacccgcatcaacgcggcggcccgggccaacggcatgacctacaaccgcctcatccagggcctgaagctggccgaggtggaggtcgaccgcaagatcctggccgacctcgcggtcaacgacgccaccgcgttcgcggccatcgtcgaggtcgcccgcgcggccgtcgcggccgagggcaccggcggcgccgccgcccaggctgcctgagttcgttcccggaacgccccccgagcgatcggggggcgtttcccattcctccaaggacggccgatgtacacgccgcgtacgccccgaatcgtgtcggcccgccgcctgcagcgccgccgggaccgcgacgccgccgggcggttcctcgccgagggcccgcaggccgtccgcgaggcgctggccgccggcgccgtgctggagctgttcggcaccccggccgggctggaccggcacgccgaactggccgcccaggcccccgaggtctccccggtcaccgacgacgctctggcggcgctggccgagacggtgcagccgcagggcctggtcgcgctctgcgagcaggtcgacgtgccgatcggcgaggcgctcgccaagggcccgcagctggtcgcggtgctcgccgagatccgggacccgggcaacgccggcaccatcctgcgcaccgccgacgccgccggggcgggcacggtgatcttcgcaggggatgccgtcgacccgtacaacggcaagtgtgtccgtgcctcggccggctcgctgttccacgtcgacgtggtccgcgccccgctcgacgtgctcgacctgctgcaggattccggcctgcaggtgctcgccaccagcggcaccggctcggacgacgtggactcgctgctcgacggcgggctgctggccgcgccgaccgcgtggctgttcggctcggaggcgcacggcctgcccggtgagctgctcgacgcggccgaccgacgggtgcgggtgccgatctacggcggggcggagagcctcaacctggccgccgcggccgccgtctgcctgtatgcgagtgctcgcgcccaacgctgagaggtagactggccgccatgtcaggtccgagggaactgtttatccggcccgctggtcgcgggcgccggatctgacccatctgcgcgactcccgatgaccggcgggctgcggctcagccgtgcctccgtacactgcccgatggctcatctggtgtgagggagttcgcccagccatgtcctaccgtaacgatccgtacgatccgaagcaggccgccctgctcgacccgtcggctctcgaagaatcgatcaaggccgccgacgccgccttcgccgacgccgcgtcgctcgacgacctgcgggcgctgaagccggcgcacctcggcgaccgctcgccggtgtcgctggcccgccgggagatcgggtcgctgccgccggccgcgaaatccgacgccggcaagcgggtcaacgaggcccggcaggcgatccaggcggcgtacgagtcgcgcgaggccgagctggaagccgaccgcgccgcccggatcctcgtcgaggagcgggtcgacgtcaccctgccgtggaaccggcgcccgcgcggcgcccggcacccgctgaccacgctgatggagaccatgggggacatgttcctcggcatgggctacgacatcgtcgacggtccccagctggagctggagtgggccaacttcgacgcgctcaacatcggcccggacaacccggtgcgcggcgcctccgacacgttcttcgtcgacctgcccggcctggtgatgcgcacccacacgtcgcccgggcaggtgcgcaccatgctcacccgcaccccgccgatctacgtggtcagcccgggccgggcataccggaccgacgagctggacgccacccacaccccggtcttccaccagatcgagggcctggtcatcgacgagggcatcaccatggcccacctgcgcggcaccctggaccacttcgcccgggcgatgttcggcccggacgcgcggacccgctggcggccgcactacttcccgttcaccgagccctccgccgagttcgacgtctggttcgcccagcaccgggacggcccgcgctgggtcgagtggggcggctgcggcatggtcaaccccaaggtgctgaccgcctgcggcatcgacccggaccggtactccgggttcgccttcggcatgggtgtcgagcggaccctgatgttccgcaacggcgtcagcgacatgcacgacatggtcgagggcgacgtgcggttcaccacgaacttcggaatggagctctgaagccgtgaagacgtcactgtcatggctgcgggaatacgtcgacctgccggccggcctcaccgccgagcggctcgacctggcgctgaacaccctcggcatggaggtcgagtccatcgtcgaccaggccgccaccgtccagggtgacctggtcgtcggccgggtcctcacgatcgaggagctgaccggtttcaagaagccgatccgcttctgcacggtcgacgtcggccgggacgcgccgcaggagatcgtctgcggcgcccgcaacttcgccgagggcgacctcgtcgtggtgatcctgcccggcggcgagctgcccggcgggttccggatcggggcgcgcaagacgtacgggcgcaactcgcacggcatgatctgctcggccgccgagctcggactctccggtgaccactcgggcatcatcgtgctgcccgcggggacgcccggtgccgacgcccggccggtggtcggactggacgacgtcctggtcgaggtggagatcaccccggaccggggatacgagatgagcgtccgcggcatcgcccgcgagctcgccacccatttcggggtggcctaccgcgacccggcggcgatcccggccgccgccgcgaccggcgactcgccgtggccggtcaccgtcgaggacaccgtcggctgcgaccggttctcggcgcgcgtcgtgcgcggcatcgacccgcaggcgcagtcccccgagtggatgcagcgccggctgatccaggccggtatccgggccatctcgctgccggtcgacatcaccaactacctgatgctggaattcggccagccgatgcacgtcttcgacctgcagcgactgcgcggcgggctgaccgtgcggcgtgcccgggccggcgagaagctcaccacgctggacggtgtcgcccggatcctcgacgccgaggacatggtgatctgcgacgagaccgggccgatctcgctggccgcggtgatgggcggcgagaccagcgagtggcagccgggcacggtcgacgtgctcctcgaagccgcgcactgggatccggtgatggtggggcgcaccgcccgccggcaccggctgttcagcgaggccgccaagcggtgggagcgcggcgtcgacccgcagctcaccctgcccgcgctggagcgcgcggtggcgatcctgctggagcacgccggcgggaccgccgacgagcggatcctcgacctcgaccacgtggccccgccggccgcgatccacctgccggccgagctcccgtcgaaggtcatcggcctgccctacccgccggaccggatcgccgagctgctcaccgcggccggctgcacggtcgccggcagcgacgtcgtcccgcccagctggcggcccgacctgcaggccccgatcgacctggtcgaggaggtggcccggctcggcggctaccacgacatcccgagtgtgctgccgccggccggggccagcaacgggctcacccccgggcagcgccgccgccgctcggtcggccgcgcgctcgccgagaacgggtacgtcgaggtgctgtcctacccgttcgtcgcgcccggcgccgcggaccagctcgggctgccggccgacgacccgcggcgcagcgcggtccggctcaccaacccgctgtccgaggaggagccgctgctgcgcaccaacctgctcggcccgctgctcggcacgctcaagcgcaacctgggccgcgggcaccgggacgtggcgctcttcgagaccggcacggtgttcctgccgcggctgaccgcggaggctccgccggtcctcggcgtcgaccggcggccggacgccgacgagtgggcgcgggccaacgcgatcgtccccgaccagccgtggcacctggccgcggtcctgaccggcgacgccgccccggccggctggtggggtgagggccgcccggcgagctgggcggacgccatcgaggccgcccgcatcgcgatcgccgccgccggggtgcccgccgcccgggtcggggtccgcgccgccgagcaggccccgtggcacccgggccgctgcgccgcgatcctggtcgacggcgaggtcgtcggccacgccggcgagctgcacccggccgtcgtctccgccctcgaactgccgaaacgcaccagcgcgatggagctttcgctggacgcgctgccggacgccccggtcgtcgacgccccgctgatctccacgttcccgccggcgctgatcgacgtggcactggtcctggaccgcacggtgccggccgacgaggtccgcgccgccctggccgagggcgcgggttcgctgctggaatcggtggcactgttcgacgtgtacgagtcggcgcagctcggcgaggggaagcggtcgctggcctacaagctgacgttccgcgcgccggaccggacgctgacctccgacgagacgatcgccgcccgcgacgccgcggtggcggtgacgacggcgcgcttcggcgcgaccctgcgcggcgcctgaccggcgaggtggtccggagccgtcacggctccggaccgcttctccccggctgttgcttcggtgcggcactgcgcggggctccaggcggcggttctcttacgcgctgcgcggggcgtcgggctgcggtttctggcggtgcggggcttcgggctgcggtttctggcggtgcggggcttcgggctgcggtttctggcggtgtgcggggcttggggccgtggctttcttgcggtgcgcggggcttcgggccgtggctttcttgcggtgcgcggggcttcgggccgtggctttcttgcggtgcgcggtccttcagaccgctgcgattgccggcgtacgccgtgaaccccgcccctcgatgtcatcgttcagcgcccggcccgatcccagggccggcgctgaacggcgttaccgagccggcccctccggtcatgagggtgatcctttcgggtgggtacttcgccggcggtcctcgtcggcggaggtgtcggcggtggaaccaggacgatcctcctcaccgacgtgagtaccggctgcgatcccgggacggttctggtcgtcggtggtgccgaggtggttttcgtcggcagtggtgctgaggcgggacagggagcggtcggcgacgatcaggatcagcagcagggtggcggtggcgagcaggaaccaggcgagctcgtgcaggcccgtcgttccggcgccgtggcggaagaaggcgccgtaggccggtgcggcgaccatcgcacctgccggtgcaccgtacgccaccagccggccgcggccggcgccgcgctcatccagagcagcccctgcgccgactgccagtcgccgccggccgggtcatccgccagcgccggccggtcctgcttcctcgggaacgacatgcccgcacgctagccgcggggtccgacacttttcaggagacgccgcgcgtggtcccgctcggccggatcgatccgcgcacagccggactccaccagccgccacggccccccgctcaacgcggtgtcgatcgcggcccgcaccgcgtccacccggtccggcgcgaccgcgaagaggatccgcaggtgcaggccgtccgcgcgggcctcggcgccggtgtggtgcggtgccaccgggcacggcccggcatgccggtgggcgccgcagagtgcgagcgtgatcgccgccccgggtgcccgggggtcggctgacgggtcgaggacgagggtcgcgtggtgcgcgtaggcctgccgcatacccccattgtcagtcgatggtgtgcccgccgttcacggtgttcccttccccggtgatgagccgggcccccggcccgcgcgaggctccggtgatcagcgctacccgttctccgtcacgcctgtcaccataggccgtgatcaacttcccggtcgacgccgtcccaccggcgatggaaccgctcccgaccagaccgctgggctccctgtacccggacgccctgtggaccgccggcgaccccgcgctcccggtgctcgagccggacggcatccacccgctgctcggcgcggtcgcccgcgcgttcgccgatcaccgtccgctcaccctctcgccggacgccgtctggctgaccatcctggagggcgtcgcccgccacatccacctgaacgccgacgacctgcgcgaccgcctggtcggccatcagggccgtgatctgctgacggtcgtcgtgcgcggcgaaccggtctggcccgatgtggtggccaagctcgccgggatgctcccgtcccgcctcggcgcgagcgactgcgatttctccaccagcaccgaggtcgaccggatggccggtcgcgtggtgctgatggacgcctattcgccgtacttcgcctatcgggtttccgtcctctgcggcatcccgtcgatctctctgaccgggacggcggaggactggcggcggatccgcgcccgcgtcgacgtgctcgccggggcaggcctcggcctggagaagtggtgccgctcgctcgccccgatcgccgatcacttcgtccgggcggcggccggcgccgcggatccggaattctggaagcggatctacaatccgatcgacgcgtacggcggtgacaagtccaccggctggatcacgcgcctgtacccctacgtgggtgagtccggcagcccgaatccgctgctcgacctcccgctcggcgagccgcggaacgccaccgggccgggcgtctcgaccgatgcggtccgggccactctcgcccgcgtgcggatgctggtcgagaacgcgattaccggcgaacagaccacggtcgccctgcatgccggcctcaccgcggtggtccaggagccgggcggctcgttgcgcccgatctccggttgtcatctgacggcggccggccccgaactcgacgacgttctcgatcggctggaccacgagggcgagatggacccacccgggcatccggccctgctcgacctgcccgaggtggccgcgctgtatcgacgtttcggctccggggtcctgttcggcggcgcctggcggctgagggtgtccggcactttcgcggagttccaggccgactggtgggtggcgccggtcttcgatctggccgacggacggtcggtgtgcgtggtgaaacactgggagtccgcgtggagttactggatcgccgtgccctgggcgagcgacaggacgattgaggaccccgccgatgtccgggtctacgggacctcactggccgccctgctggagggcgccctggacaccggcggggatctcactcacctggacagcggttcgctgtctcagtacttggcgatgtagagccgctgacccgccggccggaagccgatccgctcgtagacccgccacgagtcctcgccggaggcctccagccaggccacgtcggccccgccggcgaacagccgctcggcgatcgccgcggtgatcgccccggccagcccccggcggcggtaccgccggcggaccgcgatcccgccgacttcgctgagcccgtcgtgtggcgccaccgccgtgccgccaccggccgcctcgccgccggtggtgtacgcggcgaccagcaccgcgcccagcgaccggttgcgccgataccgggccaccgaatcggccgcggcctcgaacgagccgccgaacgcctcgttctgtgccgagatcatcccggtcaacgcggcgtcggtcgccggttccaggatctcgaacccgtccggggcgcccgccgtcaccagtgtctccggtgtgcagatcaggtactcgttgcgggactcgaccgcgaagccggcctcgatcaggaggtcttcgagctccggggcacagctcacgacgtactccagccggggtgcccggccaccgaatgcggtgaccagcgccgcgacatcgtcccgggtgatcgtcgcgccgggaaccggcgtggcgtagttgatgtgcggactgtcggtgccgtgatccaggccgagcacgaacggcccggactcggccgcgtgcggccggttacgcagattggcgacgacggagcgctgaatgcgcagatccatggtggagaaacccttccgagggcgggaaagcgaaaaagggaagcacgaaaccgcagccggacaccggggcaatcattggcttcactctttcgagcactcggggatcaaactccgcggatgaacctatcaggccgacggcttcggcgcagcggccggactgcggtgcccgtcgcggtcgaccgcgcggacgccgaactgcacgttgtccttggagatgtcgacggtggcggtgccgaccagcccgaccgcgtgcgcgccggtccagtccggtgcggtggtctcccgccagacgatctcgtatccggccaggtcgggctcggtgccgagggtccagcgcagggtggtgtcgttggtgagccgggtggtgtcgatcaccacgtccttcggggtgccgggtgcggtcgccaggctccacagggtggcggcgttgacccgggccacccgggcgatgtacgcgaagtcgcagaattccaccaggtcgccgtactgcacgccgtcgacgacccggacgtcctggtgctcgtgggcgaagttctcccgaggctcggtgaaccgggccgccgggtagccgcgcagcaggaacgagacgtggtcgctgccgcgcaggtagcggtcgcggcgccagaccacccggatgtccatgccggtctgcggattcgccgccacctcgcgggcgaagcggccgagctggcgggacggcccgtcgttctcgccgccgacgctgcgccgcacacccgcctcggcgggggtctccgcggtggggacgccctcgacgaacagccgcacggtgtgcggctcgggccggctgccgtcgtgcgcgtcgccggtgccgacgatgtcgttgctgaacatggcctcgatgtcggcgccggcgtcccggaacgactgggccaggtggtcggagccgtacaggccctgctcctcgccggcgaccgcggcgaagacgatggtcgcctccgggctgtgccgggccatcacccgggccagttccagcaccacggccaccccggacgcgtcgtcgtcggcgcccggcgcgtcactggtgtggtccagaacgtcggtcacccgcgagtcgtagtgcccggtgaccacgtagatccgctcggggctgacgctgccgcgcagggtggcgatcacgttggtgatgaccgtcggggtcggcacgcgcggtgagaccggctgggtgaacgacggggcctcgacggtcatccggccgtcggcggcctccgcgtacgaccgcaattgatcgtggatccaatcccgcgccgcgccgatcccgcgccccggatcggtctgtgacgacagcgtgtgccgggtgccgaaggcggcgagccgccgcaccgtcgcctcgatccggaccgggtcgatcgcgcgcaggatcgcccgcagctcggcgtccggcggccgccggtgtgccccggtggccggtccggccagcggcgccgccatcgcggcggacaggaggactcgccgtttcgtcatgcctgacactctggtccacagccggccggatgtcgagaaacatcgatgtcagatggtgtcgtgcaggtagcgctgcacgaccggggccagccaggcgatcgcttcggcctcgctgagcgcggtgaccgggggcaggcgcagcacgaagcggcacagggcgaagcccaggatctgggtggcgatcagcccggcgcgggtgggtgcggaggccgggtcgggggccaggcgggcggcgatcgggccgacctgggccgcgaagatctcgcgcatccggccggcggcggcctcgtggctgacgccggcccggatcagggcgagcagcgtctcatcctcggaccagcgggtgaagaagtgcgcgaccagggcgcggccgtgctcgccgggcggcaccgcggtgaggtcgggcagccgcaggtcgaactcggcggcggcggcgaacagcttctccttgttgccgtagtagcgcatcaccagggacgggtcgatccgcgcgtcggcggcgatggcgcggatggtggcgcgctcgaacccgtcggcggcgaagcgctcgcgggctgccgtgaggatcgcggcccgggtgccgtccgagcggcgcggtgcggtcatgtcgccaacagtaggtcaacaagtgttggcaaacaagcgttgacggcctagtgtcaacaagcgttggcaaacgaacgcgaggaggagccatgcacaccaccgtggcgatcgtcggcgccggccccaccggcctgctgctggccggcgacctggcccacgccggcgtcgacgtgaccgttttcgagcgccggtccggcacgtccaacctgacccgggcgttcggcgtgcacgcccgcaccctggaggtcctggacgcccgcggcctggccgacgagctgatcgcgaccggcgccaaggtcgcccggctgcgcctgttccagcagatccgggtcgacctgtccgagctgccgtcgcgctttccgttcctgctgatcaccccgcagtacaacgtcgagcgcctcctcgaggagcgcgcggtcaaggccggcgcgcggatcgtccgcggcgccgagctgaccggcctcgaccagggcacgctgaccttcggcacgcagaccgtgaccgccgactgggtggtcggcgccgacggcgtgcacagcgccgtccggcaggcggccggcctgccgtttcccgggcggtcggtgctcacctcgatcatgctggccgacgtgcggctggccaccccgccggacgatgtgctggcggtcaacgcggtcggtgacgcgttcgcgttcgtcgccccgttcggcgacggctggcaccggatcttcgcgtgggaccgccaccaccaggtctccgaccgcgagccgctcacgctcgacgaggtccgcgcggtgacccgacgggcgctgggcaccgacttcggcatcgtcgagagccgctggatgtcgcgcttccacagcgacgagcggcaggtccccagctaccgcgccggccgggtcctcctggccggcgacgcggcgcacgtccactcaccggccggcgggcagggcatgaacaccggcctgcaggacgccgcgaacctgtcctggaagctcgccgccaccgtccagggctgggcgccggccggcctgctcgacacctaccaggccgaacgccacccggtcggccggctggtgctgcgcagcagcggcgcgctgatccggctcgcgatgatccgctcggtggccggccgctggacccgcaacaccgccggatccgcgctgatggcactgccgccggtgatgcaccgcgccgccggcgtcctgtccggcgtcggcatcgactacccgcacgcgccacgcgccgccgaccaggaactccgcgacggcagccggctctacgagaggctgcgcgacggacggcacgtccttctcaccgacgatcgggtccccgccgattacgccgtacgcctgaatgtcgcaccgcctcgcgatccctccccggaagcgaccctgatccgccccgacggccacgtggcctggcacggccccgccacggacctccccggcgccctgcgcacccacctcggctccgtctgaggcggactcagccgtgggcgaccgcggtgtccacgcccgactcgtgcgggccgaggaagaccgggtcgcgaccggtgccggtgtcccaggcggctttgacggcggcggcccactcgcgggcctggccgcgggcccacagcggcttgttggcgcgctgcgtgtcgtcgccgaccccggtggcgtcgatgccgagggagcggcacagggcgaccgcccggggcacgtggaaggactggctgaccacgatcgcctgccggacgccgaagatccggccggcgcgggaacacgagtcgtaggtgtcgaagccggcgtggtccatcacgatccggtccgccgggacgccgtgcgcgaccagccagaccagcatcgcgccgggttcgtcgtacgaccagtcggcgtggtcgccggagaccaggatcgccttcaccttgccggcctgatagagccggcgggccaggtccagccgggcggccaggaaggcggacggctcgccgggcgggtccacctgggcgccgaggaccagcgccaccggggcgctcggcacgtcggccaccgagtagacgtggccggtggactcctcgcggacccacaggttgctggccgcgaccagcgcgacggagagggcggtggccagcccgcccacgaggaacagcgaggcgggacgcagccgggggagcttcagcacgcgcccactgtgacaggcgggcacccgcggccgcctaccggatccgtgccgggaacgtcctgccaccatggtcgcgtggatctcttcgtacggtgggcggccgcggccgacggcgcccggatctggcagcgtcccggcgcgaccgtggtggcctgcgccgggctggcgcactgggatcggctggtcgtgcacggcgacccggaaccgctcgccgccctggtccgcgaggtgctgccggaggtcggggtgacgttccggccgttcggcccggaggacctggtcgcggcggtggtggcccgcgcgccggagctggcagtcagcgcgcggttcgcctggatggagatcaccgagccgatcgggcggcgcccgcgccacgatccgcggtggctgaccgaggacgagtggccggaggtgtcggcgctgctcgccgagtccttcccggactcgtacgcggtgcccggcggtcccggggtacggcgctgggccgggatccgggacgccaccggacgcctggtcgcggtcgcggcggacgcctggtcgaccaccgagacgggtttcctggccggggtgaccacccggcccgacttgcgggggcgagggctcgccgccgacctgtgcgggttcgccgccgatgagctgctggccggccgggacgcaacgaccggccggcgccgggtggcgctgctggcggattaccacaacacggcggcggtcgcgacgtacaccggattgggcttcgccatccgcaaggtggccgcggcccggcagctctgagcggcgcggcgggccatcccgagcagatactcccgttcatcgcgccaccgagatcgaaccggtgagtcggcgctgcgctcgggtgcggtgcggctggccgctcgatcagcaccggcgagatcgcgtactcatcgccctctacttcactgaaaaagtccagtcagagtgcggcgccgtggtccgagttcacacccgagaccacggcgcccgtcccaaaggctagctgacggcctgctcggcaccaccgctactggccgaggtaccacctcggccgccgaaaatcacggccaggacgtcgttggcgcggaacatcactctctgctgttcactgatgtccaggccttgacgttcggaattatgcaggtgcgacagcatgtagtagggaatgagccataatctgcccaccactctaggctcaaaacgagccggatcctccgggtcgactgaattcaggacgctcaggaaccgttctgcggcaagcggatcgaagtgcccgtaccgcagcccgtacaggaatccgccgtctgcgctccattcgaactgcaacttgtcggcaatgtcatctgcattcatgcgggtcacctctcccggcctaaccggccggccaatatcccgtgatcgcatcggccgggatagtgccgcgaatcaacaattcacggtcgcgcaatgccgtctctccgatttccatccattcgtagcccggcggcacacgcagatttccggcagcatcaaccatctcactcggaaccttggtgaggtcgatcctaaccacgccgagaccattcttcatgtacttgccgaaggcaaccgccggatccttggtcgtcgagatccacggggagtcgctaggacttgacagaacgtgctgccagggctcgacgtcaccatcgcccctggcgaacaaacccttggccggatcctcgtccttccggacggctcggtacacggtgttgggcgcgaaatctgtgggaatcggctcgtcgaccccacagttgtgcacgagaactggaacatcgccagccagcacgtaatacgtatgcagtgccgcgacggtgaggttgtgcatctgctggctgccctggaagctgcgaacagcggcaaccttggcgataccaccgtacggcgtagcaagcgcggacccgggcgccagctgcccggcgtccacccaggacttggtgtcggagccccagaatgggtgatgggtagtggtgtgcagaacagccgactgcccatcagccacctgaacggtcagatcagtgaacgtggtgtcagtattggtgatcaggttggtgacgggttccgctgaggtgtatcccgtggtggcatcagtcgccagcacctggtcgccgatgcggacgtcggcgatggccttgctggtgccgtccgctagcagaacccgcgtgtcgggggtgaagctgttgcgcttgaagcagcgctcgatgaagtcgccgatcccctttatcaggggggtgtctttgaggttgcggaggaggttctccaccgcgtcgatgcccttgaggccgactgccttggacatcgccgtgagttcatcggcgttgaaggtgatcttcagcttcccgccgaggctctcggcgagttcgatgagccgggaggtggtgaccgcgccgagttccttgatcgcgttgaccagcttctcggtgccgaacttgacgacgccctagctagctagccaacgcctcatcctgcttctgcttggcctcggctcccttaccaaccacgatgttctgctgatcgatcgcccgcttggccgcagagtaggcgttcagcgaatgctgaatcgccgccgcggtcgccgcccgggcgatgtcgcgctgccggcgggcgtcccggtagtaagcggccgcgttgtcagcgtgttcatgggcgctggccgcgtccttctcggcccgcagccgctgcgccttcgcgtcggccgccgcagcctgcgcggcagccgccagcttctccgccttgtccgccagcttctccgcggcggcctgctcccgctccgccgcctgccgatacttgaccgcgttgttcgcatcaaccgtcgcgttgtgatcggcgtccagcgtcttgccggcggcctcggtcgcagtaacggcatagcacgcggtctcggcggccagcctcgcagcggtccccgcgtcagcctgcgcctgcgtcacctcggtccacgcgatgccctgcgacagcccggtcttctccaacgtctgcgccgccgtcgccgcgacacccgactgcgctgtcaccagatccgactggtgcgccgcgatcgacgcgtcctgacacgcctgaccgcgcagcgcggacaggtcggcggtatgggtcggctggcttgcctgacgccgcggcacatccgcggcgtagatcgcgtcggcttgcttggcctccttgttcgccaaggccatcgcgttcgccgcatcggtcaacgccttcgtcgccgcgacactcgcctcgatgatcttcttctgcgcgtcggcggcctgcttggcccgctgcgccagatctagaagatccgcgaccgccttcgaccgcgccgccaactagctagctagtaagcaacgacatcgggttgcggtactagctgatccggaatttcgccgactgcagggcggacgggcgcgagttcggcccgaccagcagctcgaagtcgcccggctcgacgacccggtcaccgtcggcggtgaccagggtgcagtcggcggccgggatctcgatctccacggtgacgctctcgcccgccgggacgaccacctggcggtagcccttcagctcgcggtgtgcccaggtgacgctggtgaccaggtcgctcacgtacgcctggacggtttccagggccggccgggtgccggtgttggagagtcggacggtggcccgcaccacgccgtcggccgggacctcgggctcgccgatggccaggccgtcgtacgtgatcgtggtgtagctcaggccctcgccgaaggcgaacagcgggtcctgggtgaggtcggcgtaccgggtgccgtgctggccgcgcagctggttgtagtacaccggctgctggccgacgtgccgggcggcggagatgggcagccggccactcggctcgatcaggccgaggagcagctcggcgatcgcctgcccgccgcgcatgccggggttgaacgcctgcacgatcgcggccgcaccgagtgcggacgggggcagcgccagcggcttcgagtcgatcagcacgacgatcgtcggggtgccggtcgcggcgaccgcgtcgagcagcgcgatctggccgccgagcaggtcgagggtggcggtggagcagccctcgccggtcaggttgacggtgtcgccgaccaccacgaccgcgtagtcggcgccggcggcgagctcggccgcggcggcgatccgggccgggtccaccggggccgactcggagatcggcgggcggggctgcccgtccgggaacgtctcgccctccgggtccggcaccagtcgctcgatgtcggcgccgcgctcgtggacgatctcccagccggccggcacggtggcgcgcaggccgtccagcacggtggcggtcagctcccgcgggtggccgtccggcatccagccgacctgaccggagttgccggcccagtcgccgagctgggcggagacgtcgtcggcgttcgggccgagcacggcgatccggcggctggccgcggccgggtcgatcggcagcgtgccgtcgttgcgcagcagcaccagcgagcgccgggccacctccaggttgagcgcggtgtgctccggcgagccgatcacggcgccgatccgctcggcgtccggggtgcgcgggttctcgaacaggcccagttcgaacttcaggcgcaggatacggcgtacggccgcatcgatgtccgcctccgtcaggaggcctctcgcgaccgcctcctgtgccccgtcgaagaaaccgggagtggtcatcaccaggtcgttgccggcctgcacggcgagtgccgcggcctcggcgtagtcggcgcagaccttctgctcccagaccatccggccgacgttgtcccagtcggtgaccagcgtgccggtgaagccccattcgcccttgagcacgtcgttgagcagccatttgttggcggtgatcggcacgccgtccatcgactggtagccgagcatgaagacctggcagccctccttggcggcccgctcgaacggcggcaggaaccaggagcgcagcttgcggcggctgatgtcggcctcgctggcgtcccggccgccctgcgtctcggaatagcccgcgaagtgcttggcggtggccaggatgccggtcgggtcggtcaggccggtgccctggtatccgcggatcatggcggcgcccaggtcggcgatcagcagcgggtcctcgccgaaagtctcgtcgatccgaccccagcgcagatcccgggcgatgcacaggaccggggagaaggtctggtggatgccggtggccgagacctcgaccgcggtggcccgggcgacccgttccagcagcgccgggtcccacgaggcggccatcgccagctggctcgggaagatcgtggcgcccggccagaacgagtggccgtggatgcagtcttccgcggtgagcagcggaattttcagccgggtgcgggacagcagctcgctcgcctcgatcagcttggccggcgaggtgtgcaggatcgaaccggccagtttgtcctgaatgatctcggccaggtcctgccgggcgtccagctgcagcatctgcccgatcttctcggccagcgtcatgcggctgagcaggtcgtcgacccgctgctccacggggagcgcagggtcgaggtagggggtttccgcgggcatgcgggcctccggtcgtcacgaccgcgaagcacggtctgccaaacacgaacgtgatggagtcttccagtccggaaccggttccggcaccccgggtcggttccggaacttttagagtcaccggaccgtgggttgacgatcgtggaaacagtcgatgcccgagtgggcggatcgggccggatcccggtagggtccaaagggttcgcacggatcggagcgcctcgatcaccctaggtgatcttccggctccggtcttccgacggcccgagggggagcatgagttcggccgatcgagtgctgcggggagccgcggaagcgatcgaacacatctccggcatctgcttcaagaccggcccgccacgccatctcggcgtcgagctggaatggaccacacaccacgtggatgacccggccgtcccggtcccggccgcggacctgcgtgacgcgttgggggtgcacgcgccggccgccctcggcaatccgcaaccggtgccgctgcccggcggcggcacggtcaccgccgaacccggcggtcagttggagatctcgtcggcgccggccgatgcgctgcccgccctgcacgcggcggtcaccgccgaccacgccgccctggccgggatgctcgcccgggccggcctgcgcctcggcgaccggggcatcgacgagcaccgggaacccgcccggatcctggacacgccgcggtacgccgcgatggaacgctccttcgaccgcgctgggcgcaccatgatgaccggcaccgcgggactgcaggtctgcctcgacgccggggaggcccaccagatcgccggccggtgggcggcgctgcacgacttcgggccgccgctgctggcgctgttcgcgaattcggcggtgcacgccgggcgggacaccggctgggcgtcggcccggatggccgcctggtacggcatcgacccccggcgcgccggcccggccttccgggagtccggctccccggccgaggactgggcccggtacgcgctcgacgcgccactgctctgcgtgcggcgcgacgacgggcggtgggacgcgccgcccggggtgaccttcgccgactggatcaccgacggcacaccgaccgtgtccgatctggagtatcacctcagcaccctgttcccgccggtgcgcccgcgcggctacctggaggtgcgctacctcgacacccagccggggccggactggatcgccccggccgcggtgctgaccgcgctgatggccgacgacgtgatcaccgctcagggccgggagatcgcggcgccggtcgcggggcggtggcgggccgcggcacgggacgggctgcgggatccggcggtccgcgcggcggcggccggactggccgagctcgcctgccggcacttcgaccggacggggctggatgacgtcgtccgaaagcaggtttccgatgttgttgacgcgcgcctgaaggggaacgctcgatgatcaaccccgacaagaacctgatcgccgccgaattggagcgatcgcgggcccgcaccgccctgctgaccgacgcggtcgacgacgacgacctcgtcgcgcagcactcgccgctgatgtcgccgctggtctgggacctcgcgcacgtcggcaaccaggaggagctctggctggtccgggacgtcggcggccgcgagccggtgcgtcaggacatcgacgagttgtacgacgcgttccagcacgcccgcagcgaccgccccgccctgccgctgctcgacccggccgaggcgcgccgatacatcggccaggtgcgggacaaggcgctcgacgtgctcgaccgggtgcgcctggacgagcggccgctgctcgccggtggcttcgcgttcggcatgatcgtgcaacacgagcagcagcacgacgagaccatgctcgccacccaccagctgcgcggcggctcgccggtgctctccgccccgccgcccccgcccggggacgcccgggtgcgcggcgaggtgctgatccccggcggcccgttcaccatgggcaccgacaccgacccgtgggcgctggacaacgagcggccggcgcacaccgtcgaggtcccggcgttcctgatcgacgccaccccggtgtccaacagtgactacctcgccttcatcgacgccggcggctacgacgacccgcgctggtggtcggcgcggggctggacgcaccggcacgaggccgggctgaccgcgccgatgcactggctgcgcgacggtgacgcctggctctaccggcggttcggccggatcagcccgatcgccggcgacgagccggtggtgcacgtcgactacttcgaggccgaggcgtacgcggcctgggccgggaaacggctgcccaccgaggccgagtgggagaaggccgcccgctgggacccggcgaccggccgctcccgccgcttcccgtggggcgacgagccgcccggcccggaacacgccaacctcgggcagcggcatctcgcgccggcgccggccggggcgtatccggccggcgcgtcgccgctgggcgtgcaccagctgatcggcgatgtctgggaatggacatcgaccgactggcacggctatcccggattccgggtgttcccgtacgccgagtactccgaggtcttcttcggcggtgactacaaggtgctgcgcggcggctcgttcggcaccgacgcggccgcctgccgcggcacgttccgcaactgggaccacccgatccggcggcagatcttcagcggcttccggtgcgcgcgggagctcgtctgatgtgccgccacctggcctacctcgggccgcccgagccactgtcggcgtgggtgttcgacccgccgcacgcgctgtcgcaccaggcctgggcaccacgtgacatgcgcggcgggggcaccatcaacgccgacgggttcggcgtggggtggtatccgcccgagggcgggccgccggtccggtatcgcagcgcgatgccgatctggagcgatccgacactgccccggctcgcggaggtgaccaggtcgggggcggtgctcgcggcggtccggtcggcgaccgaggggatgccggtgatcgcgacggcgacggcgccgctccaggacgggcggtggcttttcagccacaacggggtggtccgcggtttccccgggaccctcgccgacctggccgccgcgcttcccgtcgaggacctgctgaccctcgacgcgccgaccgatgcggccgccctgttcgctctggtacgccatgggctgcgcgccgggaagaccgcggaggaggcactcctgtccgtggtcaccgccgtgctgcgggtcgcgccggactcccggctgaacctgctgctgaccgatggtgatcggatcctggcgaccactgccgggcacgcgctcgccgtccgggcgaccggcgacgccgtgctggtcgcctccgagcccctcgacgaccaccccgcctggcggccgctcccggaccgccggctgttgatcgcgacccccgctgcggtggaattaggagagctgtgacttcgctggagaagcatctcgacgagcgtgacctggcccgatccctgcgcgccgacgtgcgcgacggcctgagcgccgacccgaaacggctgccgccgaaatggttctacgacgcccgcggcagccggctcttcgaggacatcacccggcttccggagtactacccgacccgcaccgaacgcgccatcctgagcgcggccgccgcggagatcgcccggctcaccgacgcgaaaaccctcgtcgaactcggctccggttcatcggagaagacccggctgctgctcgacgcgatgctggggcggggcacgctcggctccttcatcccgttcgacgtgtcccagagtgccctcgctgaggccgtcgacgcgctcagcgtcacctaccccggcctgagcatcaccggcgtggtcggcgacttcacccggcacctgcgccacctgcccgacggcgacagccgcctggtcgccttcctcggcggcacgatcggcaacctgatcccggccgagcgctccgccttcctcggcgacctgcgctccgtgctgcacgcgggtgagtggctgctgctcggcaccgatctggtcaaggaccctgccgtgctggtgcccgcctatgacgacgcggccggcgtcaccgcggagttcaaccggaacgtgctgcatgtcatcaaccgcgagctgcgggccgactttgagccactcgccttcgagcatgtggccgcctgggacccggatcgggaatggatcgagatgcggttgcggtcggtgcgggcgcagacggtgcggatcgaggatctggacctgaccgtctcgtatgcggcgggggaggagatgcggaccgagatctcggcgaagttccggcgggagcggcttgcggcggaactggcggcggcgggcttcgccctccgccattggtggtccgacccgcaggactggttcggcgtctccctggcccaggccgtcactgattgatcggccgtacgccgttggccggcggccctgagcgccgccggcccgcgcgtgttctgagcgccgccggcccgcgtgtgttctgagcgccgccggcccgcgtgtgttctgagcgccgccggcccgcgtgtgttctgagcgccgccggcccgcgcgtgttctgagcgctgccgacccgcgcgtgccctgagcgccgccggcccccgcgtgcccgcccgtgtgccggcagatcgcccgggcgtggccgccgggtctgcccgccccgggttccctccgcctggctagcctttcctccatggccgacgttgaactgatcgtcaccgacgccgaggcgctgcgcgcatggctgaccgaccaccatgcgacctcacccggcgtgtggctggccctcaccaggaagggcggcacggccacgaccctgacgtggcagcaggcggtcgacgaagccctgtgcttcggctggatcgacggccaggcccgcaagggcgacgacgccctgtcctggatccgcttcaccccacgccggccccgcagcgcctggtcccagcgcaacgtcgcgaacgtcacccgcctggaggccgccggccggatgaccccggccggccgtgccgcggtcgaggcggcccaggccgacggccgctgggccgccgcctacgccccgccctcggaggccgaggtccccgacgacctggccgccgcgatcgccgccgacccggccgcccaggccatgttcgacgtgctgaccagaggcaaccgcttcgccctgatctaccgggtcaacgcggtgaaacgcccggagacccgggcccgcaagatcaccgagatcgtcgccatgctcgcccgccacgagaccttccacccccagaaggcgaaaccggcgccgcagccgtagccgaagggcgtcgggtcggggccaccgcgaggatgggctcgcacatggcaccatgatggcccccgaggagaggcgtcaccgatgcgacatgatcagtgggacccgcgtggccctggcgggcgcctgctcaccgtcgcgacggtggcggcgatgacgctggcctgcctggtcctgagcggctgcacgttccaggatgcggagtgcagcgacggggagtatccggcggcgcaggtggacggcccgggaagctactgcgtccccgatggacaggagcccgatccgggattcgtccgttacccggccggcagagtgccccggcacgtcggggacgaatgggatgtctactggcagtcgcatcggctcgacgcacagggcaacgagatcccggacggtccacggccggcggtgagtgtcgcggtctcgccgtcccgctgacgcgacggcggcgtccgggcaggacaggccggcacccgccagatatgggcaatctcacattgctggccccgtggccgcacgttccgcgtcaggcagtcggcggcaagggccgccgcgaagctcggcaacgggggtgtgtggtgcgtggaagtccgggatttcggaagaagcggtccggtcgatcggtccggccggcatggtcgcgctgaccgcgtcgtcggtgacaggaggagtggtggctgtctcctcggatgaggagttcacccgtttcgtcgcggcccggctgcctgcgttgcgccgtctcgcctaccacctgtgcggagacatgcaccaggccgacgacctgatccaggaggccgtcaccaaactcttcgtccgctggcccttgcgggacgtcggcaacctcgacggatacctgcgcaccatgctggtgcggaccttcatcgacgagcgtcggcgcgggtggtggcggatccggctgttcgcccaccccggcgacgattccctgcccggggtcgtgccggcgtccggcgacgccttcccgatcgccgaccggaccgacctgcaggcggctctggcccgcctgccgcggcgccagcaggcggtgctggttctccgattcctgtacgaccagccgatcgacgtcgtcgccaccatgctcggctgctcgagcggcacggtgaagagtcagacggcccgcggactggccgcgatgcgcaccttgatcggcgatccgccggccggcaccggtccggtcggcgccggctcggccggcactggttcggccggcactggttcggctggcgcgggttcgggcggcactggttcggtcggtaccggttcggccggcactggttcggtcgacgccgtgaggggagcgctgcggtgagccggagtgggttcgatgagcagtacggccgggatctgctgagtcagcttccgcccatgccggacctgcccccgcacgtcgacctgtcggctgcggtcaccgcgggcaggcgccgtcgccgggcacgccggatccgtaccaccgtcacggcggccaccctgacggccgcgctcgtcgtagcggcgcccctggccgtccgcatgcaacgacgcagcgagcctcccgctgacccggcgccggcggcgacggcagctgccccggtcgcctgcacggcggcgtggctcccgatgccggacgccggcaccggtgcgcgcgtcctgaccgccggcgatgcgaccggccgctggtacgccggcagttatcgcgctcaacaggggaacggtgacaccgtcatcctgctgtggcatgacgggcggttggtcaggacgggccgattccccggtgtgggccagaagatcaacggcatcaatgccgccggtacggccgtcggtcagaccatcgacgaccggcggtaccggccctacgcgtatgtcggtgctcaggcggtgcggctgcccggtgtcaccgagggtacggccgtcgccgtcaatgatgccggcgtggtcgtcgggtcccggatggccggcgaccacccggtgccggtgcgctggcgatcggtcagcgaggcggccgtggacctgcccctgcccgccgggtacgggaccggcgaagccatcggcatcgacaaggacggcaccgtcgtcggctcgatcggtccgcacggtggtgttcccgagcagccctacctgtggcacccggacgggaccggggaactgctgccgctgccgatcgtgcagggccggccggcccgggttttcgacccgtccggcatccgggacggctgggtcgccggcgtcgtggtggcggcgggagacaagaccctgcgtccctaccggtacaacgtcgtcgaccggacgttcgagtcggttgccggccgcgacgtcgcgatctccgcgatcaacggcagcggctgggcggtcggttaccacaccggtgcgccgggaggatccgtgctgttcgccggaccgcgagagacgagactgcccgccgtccccggtgccggtgagcccgacacccgcgcggtggtgatcagcgacgacggccggaccgtcgccggcgacgggcggaacgccgcccaccggacccagcccgtgctgtggcactgcgacgtggaaacgatggcgggcaccgcgggacaccggtagcaggtgatgagaccggaccggtggccggcgcgcccgctcggggggaggagcgcgccggaccgcggctatggcgccgggttggcggcgaggcgggcgatgctgcccggcatcgcgtacatgtgggcgaaggcccgggcctgctcgccggtccaggccgacgagccgtggccgtagacgatgccggcccgggtggcggcgtccagcaggctgtgcgggctggacgagccgagcaggacgatgttgcccttgtgcagcttcacccggacggtgccggtgacccgggtctggctggagtcgaggaaggcgcggaagtcgtccatgatcgggtcgaagtagacggcctcgtgcagcaggtcgccgtacgtgttgccgagctgcgccttggtggcctgctgccggttcgacagcaccagcttctccagttcgcggtgggcggcgatgaggatcagcatgccgggggcctcgaacccgacccgggccaggttgcccaccatggtggagcccatgtggatgccgcggccgacgccgtgggcgccaccgagcacgttgagctcggagaggatcgcgtagttcggggcgtcggcggcgaccagcggggcgccgtcgacggtcgcgtcgaccacgacgcccctgtcgaaggtcaggtgcagctcgacgccggtctccggagcctggtcgatcgacttcgtgtacgtccaggcgtcctcggggaggtactcccaggagccgtaggtctcctcgccgccgatcgaggtgccgatcaggccctcgttgatcgagtacttcttgaccttctcgctgaccgcgaagccgcggctgcgcaggaactcggcctcctcctcgcggaccaggcgctcgtcccggaccggggtgatgatctccaggtgcggggccagggcgcggatcaccgcgtcgtaccggacgtggtcggcgccggcgccggtggagccgtgggcgacggcgtccgcgccgacccgcagggcgacctcgacgaccttctccgcctggatcaggcgttccgcgccgacgcacgacgggtaggcgccgttgcgcaggtagttcgccttgatcgcgtaggtgacgacccggtcgtacagctcggcgcgggcgtcgacgacgtggtgctcgaccgcgcccagttcctcggcgcgggccttgaccgcctccgcctcaccgctgtgcaggccgccggtgtcgatgttggcggtgaccacctcccagcccttctcgcggaaatccacgagggcgtacgaggtgtccagtccaccggagaaggcgagcacgatcttgcgcttggtcatcggggaagttccttttcgaagatcggcacgtacgtcctgccgtcctggacgacgtggccgggtggaagcacgtagaactcgctgctgcccgcctcgatcgccttctgcatcgcctgctggcggtcgtagtcgaacgggtcgagcaggaacgccggctcgggcagcgccgcgtcggccggcagggtcagatcggactggtacacgaacgagcccggcgaggtgtggaacgggaccgtggcgaccagcaccttcagcgcgccgaactcggtgtgcaccttgagcgcgctgttgtcgtactgggtgacgccgtcgagcttctgcgcgcggtatgcggacagggccagcgccttggccgccttgcccagcccgacggccggcatcagcgaccagagcgaccaccccacccagcgcccgggttccgcggacggcgccgcgcagtagccgccgaccggcaccgggccggtgtagccaccggcccgcatgtcctcctgcaccttgcgcagcagctgcttcacgtcggtgtcgaagcggaacgtcgagcgctccaccatggccgcgaactcgtcctgcggcaggccggcgatcagcgccgcggccggcatcaggatcaggtcgaccatcacccactgcggcatcgggatgccccggtcgccgaacgcgatgccgttgatcacgttgaacaggttgaggaagtcgcgcaccgaccagtcccgctcaccggtgtcggtgaagtcgagccagctcagcttgtgcccgtacggctgctcgttgaggtgcggccggatcgtctcgttggaggcgaggaagaactccacgccgagaccggcgagcttgccggtgtggtcggcgaagttcgggaagcgggtctccaccgagggtgggaaggtcatcgggtctcctcacggtcggtgtccgaccggctccagttgccgagtttctcggcgaggtcggcgcccgccgtgggcccgctgtcccgggcgaccacgaggatcgtgtcgtcaccggcgatggtgccgaccacgtccgcgagacccgaccggtccagcgcgctggccaggaactgcgcggcgcccggcggggtgcgcagcacggcgatgttgccgctcgagtcgacgccggtgagcagctccttgagcagccggatcagccgggccgggccctggccggtggtttcgcgcagcggccgcttgccgtcctccgggatcaggtaggcgccgctgaccttgaccgcgttcagctcctccaggtcccgggagagggtggcctgggtgacctgcacgccctcggcggcgagcaggtcggcgagctcggtctgtgagcgcacggtccggccccggatcagttcgacgatccgggcgtgccggcctgcacgagtcaccgcggaagtcacttctcgtttaccgccagcaaccaggtgagcagcgccttctgtgcgtgcaggcggttctccgcctcgtcgaagacgacgctctgcgggccgtccatcacctcgtcggtgatctcgtcgccgcggtgcgcgggcaggcagtgcagcacgatcgcgtcgggcgcggcgaccgccagcaggccgctgttgatctggtacggccggaacggggtgagccggtccttgccgtcctcctcctggcccatcgacgtccacgtgtcggtggccagcacgtgcgccccgtcggcagcctcgcggggatcgcggaacacctcgaccgacccgccggtccacgccgcgatctcggacgcgcggccgaccaccgacggcgacggatcgaagccggacggcccggccacccggacgtgcatcccggcggtggcgcccgccagcaggtaggaatgcgccatgttgttcgcggcgtcaccgacgtacgcgatgattctgcccctggtcgtcccgaaccgctcacggatggtgagcagatcggcgagcagctgacacgggtggtatccgtcggacagtgcgttgatcaccggtacgtcgacgcccgaggccagctcggccagccgctcgtcaccgtgcgtgcggtagaccatcgccgcgacgtagcgggagacgacccggccggcgtcggacaggctttcgccgcggccgaagtgcgtgttctgcgtgtccacgatgatcggctggccgcccagctcggcgatgcccgcctcgaacgacagccgggtgcgcaggctcgccttgtcgaagaagaccgcgaccgagcgcgggccggccagcggggtgaaggcgaaccggctggccttcatctcgacggccaggtcgagcacgtccgactgctcctgggggctcaggtcgtcgtcgcggaggaagtggcgcagggtcaccgaataccgtccagggcagcgatcagggcgtccgcctgatcggaggagatgatcaggggcggggcgagccg
